United States Patent 11,141,474 (ARTIFICIAL NUCLEIC ACID MOLECULES ENCODING A NOROVIRUS ANTIGEN AND USES THEREOF) - sequence listing, part 6

SEQ ID NO: 12445 - RNA, 1617 nt, Artificial Sequence
  derived and/or modified sequence opt1 from VP1__Norovirus_and/or_Norovirus-like__KP244319
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccguguccaucccgcuccccgacguccgcaacaacuucuaccacuacaaccagagcaacgaccccaccaucaagcugaucgccaugcuguacacgccccuccgggccaacaacgcgggcgacgacguguucaccguguccugccgcguccugacccggccgagccccgacuucgacuucaucuuccuggugccgcccaccguggagucccgcacgaagcccuucagcguccccgugcucaccguggaggagaugaccaacucccgguuccccaucccccuggagaagcuguucaccggcccgagcuccgccuucgucgugcagccccagaacgggcgcugcacgaccgacggcguccuccuggggaccacccagcugagccccgugaacaucugcacguuccggggcgacgugacccacaucccgggcucccgcaacuacaccaugaaccucgccagccagaacuggaacagcuacgaccccaccgaggagauccccgcgccccuggggacgccggacuucgucggcaagauccagggggugcugacccagaccacccgggccaacggcuccacgcgcgggcacaaggccaccguguacaccggcagcgccgacuucucccccaagcucggccggguccaguucgccaccgacacggacaacgacuucgagaccaaccagaacaccaaguucacccccgugggggugauccaggacggcagcacgacgccccgcaacgagccgcagcaguggguccugcccuccuacagcgggcggaacauccacaacgugcaccuggcccccgccguggcgcccaccuucccgggcgagcagcuccuguucuuccgcuccaccaugcccgggugcagcggcuaccccaacauggaccuggacugccuccugccccaggaguggguccaguacuucuaccaggaggccgccccggcccaguccgacguggcgcugcuccgguucgugaaccccgacaccggccgcguccuguucgagugcaagcugcacaagagcggguacgugaccguggcccacaccggccagcacgaccucgucaucccgcccaacggguacuuccgguucgacuccugggugaaccaguucuacacccuggcccccaugggcaacgggaccggccgccgccgguga

SEQ ID NO: 12446 - RNA, 1617 nt, Artificial Sequence
  derived and/or modified sequence opt1 from VP1__Norovirus_and/or_Norovirus-like__KF768470
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccguguccaucugcacguuccggggcgacgugacccacauccccggcagccacaacuacaccaugaaccuggccagccagaacuggaacuccuacgacccgaccgaggagauccccgcgccccuggggacgcccgacuucgucggcaagauccagggggugcucacccagaccacccgcacgaacggcagcacccgggggcacaaggccaccguguacaccggcuccgccgacuucagcccgaagcugggccgcguccaguucgccacggacaccaacaacgacuucgagaccaaccagaacaccaaguucacgcccgugggggugauccaggacggcuccaccacgccccggaacgagccccagcaguggguccugccgagcuacuccgggcgcaacauccacaacgugcaccucgcccccgccguggcccccaccuuccccggcgagcagcugcuguucuuccggagcaccaugccggggugcuccggcuaccccaacauggaccucgacugccugcugccccaggaguggguccaguacuucuaccaggaggcggcccccgcccagagcgacguggcccuccugcgcuucgugaacccggacaccggccggguccuguucgagugcaagcuccacaaguccggguacgugaccguggcgcacaccggccagcacgaccuggucaucccgcccaacggguacuuccgcuucgacagcugggugaaccaguucuacacccuggcccccaugggcaacgggacgggccggcgccgcuga

SEQ ID NO: 12447 - RNA, 1617 nt, Artificial Sequence
  derived and/or modified sequence opt1 from VP1__Norovirus_and/or_Norovirus-like__KC456073
augaagauggccagcuccgacgccaaccccagcgacggcuccgcggccaaccuggugccgaaggucaacaacgaggugauggcccucgagcccguggucggggccgccaucgcggcccccguggccggccagcagaacgugaucgaccccuggaucaagaacaacuucguccaggcccccgggggcgaguucaccgugagccccaagaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggaggccgcccccgcgcaguccgacgucgcccuccugcgguucgugaaccccgacaccgggcgcgugcuguucgagugcaagcuccacaagagcggcuacgucaccguggcccacaccgggcagcacgaccuggugaucccgcccaacggcuacuuccgguucgacuccugggucaaccaguucuacacccuggcccccauggggaacggcacgggccgccggcgcuga

SEQ ID NO: 12448 - RNA, 1617 nt, Artificial Sequence
  derived and/or modified sequence opt1 from VP1__Norovirus_and/or_Norovirus-like__KC456072
augaagauggccagcuccgacgccaaccccagcgacggcuccgcggccaaccuggugcccaaggucaacaacgaggugauggcccucgagcccguggucggggccgccaucgcggcccccguggccggccagcagaacgugaucgaccccuggaucaagaacaacuucguccaggcccccgggggcgaguucaccgugagccccaagaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccgcgacuucgaggccaaccagaacaccaaguucacccccgucggggugauccaggacggcagcacgacccaccggaacgagccccagcagugggugcugcccuccuacagcgggcgcaacaccccgaacguccaccucgcccccgcgguggcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacgucgcccuccugcgcuucgugaacccggacaccggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggacgggccggcgccgcuga

SEQ ID NO: 12449 - RNA, 1617 nt, Artificial Sequence
  derived and/or modified sequence opt1 from VP1__Norovirus_and/or_Norovirus-like__JX459622
augaagauggccagcaacgacgcccaccccuccgacggcagcgcggccacccuggugccgaaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgagcuccacgugcugcuggccgggaacgccuucacggccggcaagaucaucaucgccgccgucccgcccaacuucccgaccgaggggcucagccccucccaggugaccauguucccccacaucaucguggacguccggcagcuggagcccgugcugaucccgcuccccgacgugcgcaacaacuucuaccacuacaaccagagcaacgacuccaccaucaagcugaucgccaugcuguacacgccccuccgggcgaacaacgccggcgaggacgucuucaccgugagcugccgcgugcugacccggcccuccccggacuucgacuucaucuuccuggucccgcccaccguggagagccgcacgaagcccuucaccgugcccauccucaccgucgaggagaugaccaacucccgguuccccaucccccuggagaagcuguucacgggccccagcggggccuucguggugcagccgcagaacggccgcugcaccaccgacgggguccuccugggcaccacgcagcugucccccgugaacaucugcaucuuccggggcgacgucacccacaucgccgggagccgcaacuacaccaugaaccucgccgcgcugaacuggaacaacuacgaccccaccgaggagaucccggcgccccugggcacgcccgacuucguggggaagauccagggcgugcucacccagaccaccaagggggacggcuccacgcggggccacaaggccaccgucuacaccgggagcgccgacuucacccccaagcugggcuccgugcaguucagcacggacaccgagaacgacuucgagacccaccagaacaccaaguucacgccggugggggucauccaggacggcagcaccacccaccgcaacgagccccagcagugggugcugcccuccuacagcgggcggaacgugcacaacguccaccucgcccccgccguggccccgaccuuccccggcgagcagcugcuguucuuccgcuccacgaugcccggcugcagcggguaccccaacauggaccucgacugccugcugccgcaggagugggugcagcacuucuaccaggaggccgcccccgcgcaguccgacgucgcccuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacggcacggggcgccggcgcuga

SEQ ID NO: 12450 - RNA, 1617 nt, Artificial Sequence
  derived and/or modified sequence opt1 from VP1__Norovirus_and/or_Norovirus-like__KX514290
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccauccugaccgugggcgagaugacgaacucccgguuccccaucaaccuggagcgccucuucaccgggcccagcuccgccaacgugguccagccccagaacggccggugcaccaucgacggggagcugcugggcaccacgcagcucagcuccgugaacaucugcaccuuccgcggcgacgucacccacaucgggagcacccaccacuggacgaugaaccuggccagcccgaacuggaacaacuacgaccccaccgaggagacccccgccccgcugggcacccccgacuucguggggaagauccacggcaugcucacgcagaccacccaggagaacggguccacccgggcgcaccgcgccacgguguacgucggcagcgccgacuucacccccaagcugggcaaggugcaguucgagaccgacaccacgaacgaccuggacgcccaccagaacaccaaguucacccccgugggggucgugcagggcggggaguccccgaagggcagcgagccccagcagugggugcuccccuccuacagcgggcgggacacccccaacguccaccuggccccggcgguggcccccacguuccccggcgagcagcuccucuucuuccgcuccaccauccccggcugcgggggccacccgaacaugaaccuggacugccugcucccccaggagugggugcagcacuucuaccaggaggccgcccccgcgcagagcgacgucgcccugcugcgguucgugaaccccgacaccucccgcgugcuguucgagugcaagcugcacaagagcggguacgucaccguggcccacacgggccagcacgaccuggugaucccgcccaacggguacuuccgguucgacuccugggucaaccaguucuacacccucgcccccaugggcaacggcaccgggcgcaagcgguga

SEQ ID NO: 12451 - RNA, 1617 nt, Artificial Sequence
  derived and/or modified sequence opt1 from VP1__Norovirus_and/or_Norovirus-like__KP784695
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgaccccaccgaggagaucccggcgccccuggggacgcccgacuucgucggcaagauccagggggugcucacccagaccacccggacggacggcagcacccgcgggcacaaggccaccguguacaccggcuccgccgacuucagccccaagcugggccggguccaguucgccacggacaccgacaacgacuucgugaccaaccagaacaccaaguucacgccggugggggucauccaggacggcaacaccacgccccgcaacgagccccagcagugggugcugcccuccuacagcgggcggaacacccacaacgugcaccucgccccggccgucgcccccaccuuccccggcgagcagcugcuguucuuccgcuccaccaugcccgggugcagcggcuacccgaacauggaccucgacugccugcugccccaggagugggugcaguacuucuaccaggaggcggcccccgcccaguccgacguggcccuccugcgguucgucaaccccgacaccggccgcgugcuguucgagugcaagcuccacaagagcggguacgugaccgucgcgcacaccggccagcacgaccuggugaucccgcccaacggguacuuccgguucgacuccugggugaaccaguucuacacgcuggcccccaugggcaacgggaccggccgccgccgguga

SEQ ID NO: 12452 - RNA, 1617 nt, Artificial Sequence
  derived and/or modified sequence opt1 from VP1__Norovirus_and/or_Norovirus-like__KX608865
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucgccggcucccgcaacuacaccaugaaccuggccagccagaacuggaacagcuacgaccccaccgaggagaucccggcgccccuggggacgcccgacuucgucggcaagauccagggggugcucacccagaccacccggacggacggcuccacccgcgggcacaaggccaccguguacaccggcagcgccgacuucucccccaagcugggccggguccaguucgccacggacaccgacaacgacuucgugaccaaccagaacaccaaguucacgccggugggggucauccaggacggcagcaccacgccccgcaacgagccccagcagugggugcugcccuccuacagcgggcggaacacccacaacgugcaccucgccccggccgucgcgcccaccuuccccggcgagcagcugcuguucuuccgcuccaccaugcccgggugcagcggcuacccgaacauggaccucgacugccugcugccccaggagugggugcaguacuucuaccaggaggccgcccccgcccaguccgacguggcgcuccugcgguucgucaaccccgacaccggccgcgugcuguucgagugcaagcuccacaagagcggguacgugaccgucgcccacaccggccagcacgaccuggugaucccgcccaacggguacuuccgguucgacuccugggugaaccaguucuacacgcuggcccccaugggcaacgggaccggccgccgccgguga

SEQ ID NO: 12453 - RNA, 1617 nt, Artificial Sequence
  derived and/or modified sequence opt1 from VP1__Norovirus_and/or_Norovirus-like__AB972500
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgaccccaccgaggagaucccggcgccccuggggacgcccgacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgccggugggggugauccaggacggcuccaccacgccccgcaacgagccccagcaguggguccugcccagcuacuccgggcggaacauccacaacgugcaccucgccccggccguggcccccaccuuccccggcgagcagcugcuguucuuccgcagcaccaugcccgggugcuccggcuacccgaacauggaccucgacugccugcugccccaggaguggguccaguacuucuaccaggaggcggcccccgcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12454 - RNA, 1617 nt, Artificial Sequence
  derived and/or modified sequence opt1 from VP1__Norovirus_and/or_Norovirus-like__KT033902
augaagauggccagcuccgacgccaaccccagcgacggcuccaccgcgaaccugauccccgaggugaacaacgaggucauggcccucgagcccguggugggggccgccaucgccgcgcccgucgccggccagcagaacgugaucgaccccuggauccgcaacaacuucgugcaggcccccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaagaucaucuucgccgccgugccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggccaacaacgcgggcgacgacaucuucaccgucuccugccgcgugcugacccggcccagcccggacuucgacuucaucuuccucgugccgcccaccgucgagucccgcacgaagcccuucagcgugcccgugcugaccgucgaggagaugaccaacucccgguuccccaucccccuggagaagcuguucaccggccccagcuccgcccugguggugcagccgcagaacgggcgcugcacgaccgacggcguccugcucgggaccacccagcugagccccgugaacaucugcacguuccggggcgacgucacccacauccccggcucccgcaacuacaccaugaaccuggccagccagaacuggaacagcuacgacccgaccgaggagauccccgcgccccucgggacgcccgacuucgugggcaagauccagggggugcugacccagaccacccggacgaacggcuccacccgcgggcacaaggccaccgucuacaccggcagcgccgacuucuccccgaagcugggccgggugcaguucgccacggacaccgacaacgacuucgagaccaaccagaacaccaaguucacgcccgugggggucauccaggacggcagcaccacgccccgcaacgagccccagcagugggugcucccguccuacagcgggcggaacauccacaacgugcaccuggcccccgccgucgcccccaccuuccccggcgagcagcuccucuucuuccgcuccaccaugccggggugcagcggcuaccccaacauggaccuggacugccugcucccccaggagugggugcaguacuucuaccaggaggcggcccccgcccaguccgacguggcccugcugcgguucgucaacccggacaccggccgcguccucuucgagugcaagcugcacaagagcggguacgugaccguggcgcacaccggccagcacgaccuggugaucccgcccaacggguacuuccgguucgacuccugggugaaccaguucuacacccucgcccccaugggcaacgggacgggccgccgccgguga

SEQ ID NO: 12455 - RNA, 1617 nt, Artificial Sequence
  derived and/or modified sequence opt1 from VP1__Norovirus_and/or_Norovirus-like__KR904220
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucguggggaacgccuucacggccggcaagaucaucuucgcggccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccagcgacuccaccaucaagcugaucgccaugcucuacacgccccugcgggccaacaacgccggcgacgacguguucaccgucagcugccgcgugcugacccggcccuccccggacuucgacuucaucuuccucgugccgcccaccgucgagagccgcacgaagcccuucuccgugcccgugcugaccgucgaggagaugaccaacagccgguuccccaucccccuggagaagcuguucaccggccccuccagcgcguucgugguccagccgcagaacgggcgcugcacgaccgacggcgugcuccuggggaccacccagcucucccccgugaacaucugcacguuccggggcgacgucacccacaucagcggcagccacaacuacaccaugaaccuggccucccagaacuggaacagcuacgaccccaccgaggagaucccggcgccccuggggacgcccgacuucgugggcaagauccagggggugcucacccagaccacccgcacggacggcuccacccgggggcacaaggccaccgucuacaccggcagcacggacuucacccccaagcugggccgcgcccaguucgccaccgacaccgacaacgacuucgagacgaaccagaacaccaaguucaccccggugggggugauccaggacggcgggaccacgcaccggaacgagccccagcaguggguccugcccuccuacagcggccgcaacacccacaacgugcaccucgcccccgccguggccccgaccuuccccggggagcagcugcuguucuuccgguccaccaugcccggcugcagcggcuaccccaacauggaccucgacugccugcugccgcaggaguggguccaguacuucuaccaggaggccgcgcccgcccaguccgacguggcccuccugcgcuucgugaaccccgacaccgggcggguccuguucgagugcaagcuccacaagagcggcuacgugacgguggcccacaccgggcagcacgaccuggucaucccgcccaacggcuacuuccgcuucgacuccugggugaaccaguucuacacccuggcgcccauggggaacggcaccggccggcgccgcuga

SEQ ID NO: 12456 - RNA, 1617 nt, Artificial Sequence
  derived and/or modified sequence opt1 from VP1__Norovirus_and/or_Norovirus-like__LN854566
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugucccacaucacgggcagccgcaacuacaccaugaaccuggccagccagaacuggaacaacuacgaccccaccgaggagaucccggcgccccuggggacccccgacuucgucggcaagauccaggggaugcucacgcagaccacccgggccgacggcuccacccgcgggcacaaggccacgguguacaccggcagcgccgacuucgcccccaagcugggccgggugcaguucgagaccgacaccgaccacgacuucgaggccaaccagaacacgaaguucaccccggucggggugauccaggacggcuccaccacccaccgcaacgagccccagcagugggugcugcccagcuacuccgggcggaacacgcacaacguccaccucgcgcccgccguggccccgaccuuccccggcgagcagcugcuguucuuccgcagcaccaugcccgggugcuccggcuaccccaacauggaccucgacugccugcugccgcaggagugggugcaguacuucuaccaggaggccgcgcccgcccagagcgacgucgcccuccugcgguucgugaaccccgacaccggccgcgugcuguucgagugcaagcuccacaaguccggguacgucacgguggcccacaccggccagcacgaccuggugaucccgcccaacggguacuuccgguucgacagcugggucaaccaguucuacacccuggcccccaugggcaacgggaccggccgccgccgguga

SEQ ID NO: 12457 - RNA, 1617 nt, Artificial Sequence
  derived and/or modified sequence opt1 from VP1__Norovirus_and/or_Norovirus-like__KP244313
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgaccccaccgaggagaucccggcgccccuggggacgcccgacuucgucggcaagauccagggggugcucacccaggccacccggaccaacggcagcacgcgcgggcacaaggccaccguguacaccggcuccgccgacuucagccccaagcugggccggguccaguucgccaccgacacggacaacgacuucgagaccaaccagaacaccaaguucaccccggugggggugauccaggacggcuccacgacgccccgcaacgagccccagcaguggguccugcccagcuacuccgggcggaacauccacaacgugcaccucgccccggccguggcgcccaccuuccccggcgagcagcugcuguucuuccgcagcaccaugcccgggugcuccggcuacccgaacauggaccucgacugccugcugccccaggaguggguccaguacuucuaccaggaggccgcccccgcccagagcgacguggcgcuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggaccggccgccgccgguga

SEQ ID NO: 12458 - RNA, 1617 nt, Artificial Sequence
  derived and/or modified sequence opt1 from VP1__Norovirus_and/or_Norovirus-like__KP096342
augaagauggccagcuccgacgccaaccccagcgacggcuccgcggccaaccuggugcccgaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcucccgcaacuacaccaugaaccuggccagccagaacuggagcaacuacgacccgaccgaggagauccccgcgccccuggggacgcccgacuucgugggcaagauccaggggaugcucacccagaccacccggacggacggcuccacccgcgggcacaaggccaccgucuacaccggcagcgccgacuucgccccgaagcugggccgggugcaguucgagacggacaccgaccacgacuucgaggccaaccagaacaccaaguucacccccgugggggucauccaggacggcuccacgacccaccgcaacgagccccagcagugggugcugcccagcuacuccgggcggaacaccccgaacgugcaccucgcccccgcggucgcccccaccuuccccggcgagcagcugcuguucuuccgcagcacgaugccggggugcuccggcuaccccaacauggaccucgacugccugcugccccaggagugggugcaguacuucuaccaggaggccgcccccgcgcagagcgacguggcccuccugcgguucgucaacccggacaccggccgcgugcuguucgagugcaagcuccacaaguccggguacgugaccgucgcccacaccggccagcacgaccuggugaucccgcccaacggguacuuccgguucgacagcugggugaaccaguucuacacccuggcccccaugggcaacgggacgggccgcaagcgcuga

SEQ ID NO: 12459 - RNA, 1617 nt, Artificial Sequence
  derived and/or modified sequence opt1 from VP1__Norovirus_and/or_Norovirus-like__KM514067
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggguccucacccagaccacccggacggacggcagcacccgcgggcacaaggccaccguguacaccggcuccgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccagcuacuccggccggaacaccccgaacguccaccucgcccccgcgguggcccccaccuuccccggggagcagcugcuguucuuccgcagcacgaugccgggcugcuccggcuaccccaacauggaccucgacugccugcugccgcccgagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacccuggcccccauggggaacggcacgggccgccgccgguga

SEQ ID NO: 12460 - RNA, 1617 nt, Artificial Sequence
  derived and/or modified sequence opt1 from VP1__Norovirus_and/or_Norovirus-like__KF060049
augaagauggccagcuccgacgccaaccccagcgacggcuccaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggcgggcaagaucaucuucgccgccgugccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggccaacaacgcgggcgacgacgucuucaccguguccugccgcgugcugacccggcccagcccggacuucgacuucaucuuccucgucccgcccaccguggagucccgcacgaagcccuucagcgugcccguccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucuccggcagccgcaacuacaccaugaaccuggccagccagaacuggaacuccuacgaccccaccgaggagaucccggcgccccuggggacgcccgacuucgugggcaagauccaggggguccucacccagaccacccggacggacggcagcacccgcgggcacaaggccaccguguacaccggcuccgccgacuucagccccaagcugggccgggugcaguucgccacggacaccgacaacgacuucgucaccaaccagaacaccaaguucacgccggugggggugauccaggacggcuccaccacgccccgcaacgagccccagcaguggguccugcccagcuacuccgggcggaacacccacaacgugcaccucgccccggccguggcccccaccuuccccggcgagcagcugcuguucuuccgcagcaccaugcccgggugcuccggcuacccgaacauggaccucgacugccugcugccccaggaguggguccaguacuucuaccaggaggcggcccccgcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacgcuggcccccaugggcaacgggaccggccgccgccgguga

SEQ ID NO: 12461 - RNA, 1617 nt, Artificial Sequence
  derived and/or modified sequence opt1 from VP1__Norovirus_and/or_Norovirus-like__KF059998
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagauccccgcgccccuggggacgcccgacuucgugggcaagauccaggggguccucacccagaccaccuccgccaacggcagcacgcgcgggcacaaggccaccguguacaccggcuccgccgacuucagcccgaagcugggccgggugcaguucgccaccgacacgaacaacgacuucgagaccaaccagaacaccaaguucacccccgucggggugauccaggacggcaacacgacgccccgcaacgagccccagcagugggugcugccguccuacagcgggcggaacauccacaacguccaccucgcccccgccguggcgcccaccuuccccggcgagcagcugcuguucuuccgcuccaccaugccggggugcagcggcuaccccaacauggaccucgacugccugcugccccaggagugggugcaguacuucuaccaggaggccgcccccgcccaguccgacgucgcgcuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggaccggccgccggcgcuga

SEQ ID NO: 12462 - RNA, 1617 nt, Artificial Sequence
  derived and/or modified sequence opt1 from VP1__Norovirus_and/or_Norovirus-like__JX439833
augaagauggccagcuccgacgccaaccccagcgacggcuccaaggcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccgugcugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgacgugacgcacaucccgggcagccgcaacuacaccaugaaccuggccucccagaacuggaacagcuacgaccccaccgaggagauccccgcgccccuggggaccccggacuucgucggcaagauccagggggugcucacgcagaccacccggaccaacggcagcacgcgcgggcacaaggccaccguguacaccggcuccgccgacuucagccccaagcugggccggguccaguucgccaccgacacggacaacgacuucgagaccaaccagaacaccaaguucacccccgugggggugauccaggacggcuccacgacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggaccggcucccgccgcuga

SEQ ID NO: 12463 - RNA, 1617 nt, Artificial Sequence
  derived and/or modified sequence opt1 from VP1__Norovirus_and/or_Norovirus-like__JQ613548
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgaccccgccgaggagaucccggcgccccuggggacccccgacuucgucggcaagauccagggggugcucacgcagaccacccggaccaacggcagcacgcgcgggcacaaggccaccguguacaccggcuccgccgacuucagccccaagcugggccggguccaguucgccaccgacacggacaacgacuucgagaccaaccagaacaccaaguucaccccggugggggugauccaggacggcuccacgacgccccgcaacgagccccagcaguggguccugcccagcuacuccgggcggaacauccacaacgugcaccucgccccggccguggcgcccaccuuccccggcgagcagcugcuguucuuccgcagcaccaugcccgggugcuccggcuacccgaacauggaccucgacugccugcugccccaggaguggguccaguacuucuaccaggaggccgcccccgcccagagcgacguggcgcuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcccccaugggcaacgggaccggccgccgccgguga

SEQ ID NO: 12464 - RNA, 1617 nt, Artificial Sequence
  derived and/or modified sequence opt1 from VP1__Norovirus_and/or_Norovirus-like__JN595867
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagacgcccgcgccccuggggaccccggacuucgucggcaagauccagggggugcucacccagaccacgcggaccaacggcagcacccgcgggcacaaggccaccguguacacgggcuccgccgacuucagccccaagcugggccggguccaguucgccaccgacaccgacaacgacuucgagaccaaccagaacacgaaguucacccccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacgcuggcccccaugggcaacgggaccggccgccgccgguga

SEQ ID NO: 12465 - RNA, 1617 nt, Artificial Sequence
  derived and/or modified sequence opt1 from VP1__Norovirus_and/or_Norovirus-like__AB629944
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucagcggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcuccuacgugaccguggcgcacaccgggcagcacgaccuggucaucccgcccaacggcuacuuccgguucgacagcugggugaaccaguucuacacgcuggcccccauggggaacggcaccgggcgccgccacuga

SEQ ID NO: 12466 - RNA, 1617 nt, Artificial Sequence
  derived and/or modified sequence opt1 from VP1__Norovirus_and/or_Norovirus-like__AB541192
augaagauggccagcuccgacgccaacccgcccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgccccgcugggccccgaccucaaccccuaccugucccaccuggcccgcauguacaacggcuacgccgggggcuucgaggugcaggucauccucgccgggaacgcguucaccgccggcaagaucaucuucgccgccgugcccccgaacuuccccacggaggggcugagccccucccaggugaccauguucccccacaucaucgucgacgugcggcagcuggagccggugcucaucccccugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggccgucccccgacuucgacuucaucuuccucgugccgcccaccguggagagccgcaccaagcccuucacgguccccauccugaccguggaggagaugaccaacucccgguuccccaucccccuggagaagcuguucaccggcccgagcggggccuucgugguccagccccagaacggccgcugcacgaccgacggggugcugcugggcaccacccagcucucccccgucaacaucugcacguuccggggcgacgccacccacaucgccgggagccgcuccuacaccaugaaccuggcgagccugaacuggaacaacuacgacccgaccgaggagauccccgcgccccucggcacgcccgacuucguggggaagauccagggcaugcugacccagaccaccaagggggacggcuccacgcggggccacaaggccaccguguacaccgggagcgccccguucacccccaagcugggcagcguccaguucuccacggacaccgagaacgacuuccagacccaccagaacaccaaguucacgcccgugggggugauccaggacggcagcaccacccaccgcaacgagccccagcaguggguccucccguccuacagcgggcgggacgugcacaacgugcaccuggcccccgccgucgcccccaccuuccccggcgagcagcuccucuucuuccgcuccacgaugccgggcugcagcggguaccccaacauggaccuggacugccugcucccccaggagugggugcagcacuucuaccaggaggccgcccccgcgcaguccgacguggcccugcugcgguucgucaacccggacaccggccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacggcacggggcgccggcgcuga

SEQ ID NO: 12467 - RNA, 1617 nt, Artificial Sequence
  derived and/or modified sequence opt1 from VP1__Norovirus_and/or_Norovirus-like__AB504314
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggccgcauccaggggaugcucacccagacgaccaagggcgacggguccacccggggccacaaggccaccgucagcacgggcagcguggacuucaccccgaagcugggguccgugcaguucgccaccgacaccgacaacgacuucgagacgggccagaacacccgcuucacccccgucggggugauccaggacggcagcuccgcccugcggaacgagccccagcagugggugcuccccgacuacagcgggcgcaccguccacaacgugcaccuggccccggccguggcccugacguuccccggcgagcagcuccuguucuuccgguccaccaugcccggcugcagcggguaccccaacauggaccuggacugccuccugccgcaggaguggguccagcacuucuaccaggaggcggcccccucccagagcgacguggcccugcuccgcuucgugaaccccgacaccggccggguccuguucgagugcaagcugcaccgcgccggguacgugaccguggcgcacaccggccagcacgaccucgucaucccgcccaacggguacuuccgcuucgacuccugggugaaccaguucuacacgcuggcccccaugggcaacggcgccgggcggcgccgguga

SEQ ID NO: 12468 - RNA, 1617 nt, Artificial Sequence
  derived and/or modified sequence opt1 from VP1__Norovirus_and/or_Norovirus-like__KX514350
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccaguccggcaacacgaagaucuacaccaugaaccuggccagccccaacuggaacaacuacgaccccaccgaggagaucccggcgccccuggggacccccgacuucgucggcaagauccaggggaugcucacgcagaccaccaagggcgaggggagcacccgcggccaccgggccacgguguacgugggcuccgccaacuacgcccccaagcuggggcgcguccaguucgagaccgacaccaccgacgaccuggacgcccaccagaacacgaaguucaccccggugggcgugguccagagcggggagucccccaagggcagcgagccccagcagugggugcuccccuccuacagcgggcgggacaccccgaacgugcaccuggcccccgcggucgcccccaccuuccccggcgagcagcuccucuucuuccgcuccacgaucccgggcugcgggggccaccccaacaugaaccuggacugccugcucccccaggagugggugcagcacuucuaccaggaggccgcccccgcgcagagcgacguggcccugcugcgguucgucaacccggacaccucccgcguccucuucgagugcaagcugcacaagagcggguacgugaccguggcccacaccggccagcacgaccuggugaucccgcccaacggguacuuccgguucgacuccugggugaaccaguucuacacgcucgcccccaugggcaacggcaccgggcgcaagcgguga

SEQ ID NO: 12469 - RNA, 1617 nt, Artificial Sequence
  derived and/or modified sequence opt1 from VP1__Norovirus_and/or_Norovirus-like__KX514342
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccaguccggcaacacgaagaucuacaccaugaaccuggccagccccaacuggaacaacuacgaccccaccgaggagaucccggcgccccuggggacccccgacuucgucggcaagauccaggggaugcucacgcagaccaccaagggcgaggggagcacccgcggccaccgggccacgguguacgugggcuccgccaacuacgcccccaagcuggggcgcguccaguucgagaccgacaccaccgacgaccuggacgcccaccagaacacgaaguucaccccggugggcgugguccagagcggggagucccccaagggcagcgagccccagcagugggugcuccccuccuacagcgggcgggacaccccgaacgugcaccuggcccccgcggucgcccccaccuuccccggcgagcagcuccucuucuuccgcuccacgaucccgggcugcgggggccaccccaacauggaccuggacugccugcucccccaggagugggugcagcacuucuaccaggaggccgcccccgcgcagagcgacguggcccugcugcgguucgucaacccggacaccucccgcguccucuucgagugcaagcugcacaagagcggguacgugaccguggcccacaccggccagcacgaccuggugaucccgcccaacggguacuuccgguucgacuccugggugaaccaguucuacacgcucgcccccaugggcaacggcaccgggcgcaagcgguga

SEQ ID NO: 12470 - RNA, 1617 nt, Artificial Sequence
  derived and/or modified sequence opt1 from VP1__Norovirus_and/or_Norovirus-like__KX514280
augaagauggccagcaacgacgccaaccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaaggacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcuccaagcccuucagcguccccgugcugacgguggaggagaugaccaacucccgguuccccgucacccuggacaagcuguucaccggccccagcuccacgaucgugguccagccccagaacgggcgcugcaccaucgacggcgugcugcuggggaccacccagcucagcccggugaacaucugcacguuccggggcgacgucacccacccccgcgacuccaccaucuacaccaugaaccuggccagccccaacuggaacacguacgacccgaccgaggagauccccgcgccccugggcacccccgacuucguggggaagauccagggcaugcucacccagacgaccaagggggccggcagcacccgggggcaccgcgccaccguguacgucggcuccgccaacuacgccccgaagcugggccgggugcaguucgagacgaacaccagcgacgaccuggacgcccaccagaacaccaaguucacccccgugggggucauccagggcggggaguccgcccaccgcagcgagccccagcagugggugcuccccuccuacagcggccgggacaucccgaacgugcaccuggcccccgcggucgcccccacguuccccggggagcagcuccucuucuuccgcuccaccaucccgggcugcggcgggcaccccaacauggaccuggacugccugcucccccaggagugggugcagcacuucuaccaggaggccgcccccgcgcagagcgacguggcccugcugcgguucgucaacccggacaccucccgcguccucuucgagugcaagcugcacaagagcggcuacgugaccguggcccacacggggcagcacgaccuggugaucccgcccaacggcuacuuccgguucgacuccugggugaaccaguucuacacccucgcccccauggggaacggcaccggccgcaagcgcuga

SEQ ID NO: 12471 - RNA, 1617 nt, Artificial Sequence
  derived and/or modified sequence opt1 from VP1__Norovirus_and/or_Norovirus-like__LC177654
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12472 - RNA, 1617 nt, Artificial Sequence
  derived and/or modified sequence opt1 from VP1__Norovirus_and/or_Norovirus-like__KX354026
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagauccccgcgccccuggggacgcccgacuucgugggcaagauccaggggguccucacccagaccaccuccacgaacggcagcacccgcgggcacaaggccaccguguacaccggcuccgccgacuucagcccgaagcugggccgggugcaguucgccacggacaccaacaacgacuucgagaccaaccagaacaccaaguucacgcccgucggggugauccaggacggcuccaccacgccccgcaacgagccccagcagugggugcugccgagcuacuccgggcggaacauccacaacguccaccucgcccccgccguggcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacgucgcccuccugcgguucgugaacccggacaccggccgcgugcuguucgagugcaagcuccacaaguccggguacgucaccguggcgcacaccggccagcacgaccuggugaucccgcccaacggguacuuccgguucgacagcugggucaaccaguucuacacccuggcccccaugggcaacgggacgggccgccggcgcuga

SEQ ID NO: 12473 - RNA, 1617 nt, Artificial Sequence
  derived and/or modified sequence opt1 from VP1__Norovirus_and/or_Norovirus-like__KR904218
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccggaucaucgucgacgugcgccagcuggagcccgugcucaucccgcugcccgacguccggaacaacuucuaccacuacaaccaguccaacgaccccaccaucaagcugaucgccaugcucuacacgccccugcgcgccaacaacgcgggcgacgacguguucaccgugagcugccggguccugacccgcccgucccccgacuucgacuucaucuuccucgugccgcccaccguggagagccggacgaagcccuucuccguccccauccugaccguggaggagaugaccaacagccgcuuccccaucccccuggagaagcuguucaccggcccguccagcgccuucgugguccagccccagaacgggcggugcuccacggacggcgugcuccuggggaccacccagcucagccccgucaacaucugcaccuuccgcggcgacgugacgcacaucgccggcucccacaacuacaccaugaaccuggccagccagaacuggagcuccuacgacccgaccgaggagauccccgcgccccuggggacccccgacuucgugggcaagauccaggggguccucacgcagaccacccggaccgacggcagcacgcgcgggcacaaggccaccguguacaccggcuccgccgacuucagcccgaagcugggccgggugcaguucgccaccgacacgaacaacgacuucgaguccaaccagaacaccaaguucgcccccgucggggugauccaggacggcgggaccgcccaccgcaacgagccccagcagugggugcugcccagcuacuccggccggaacauccacaacguccaccucgcgccggccguggcccccaccuuccccggggagcagcugcuguucuuccgcagcacgauccccggcugcuccggcuacccgaacauggaccucgacugccugcugccccaggagugggugcaguacuucuaccaggaggccgcgcccgcccagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacgcuggcccccauggggaacggcaccggccgccgccgguga

SEQ ID NO: 12474 - RNA, 1617 nt, Artificial Sequence
  derived and/or modified sequence opt1 from VP1__Norovirus_and/or_Norovirus-like__KJ678150
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccacgccccuggagaagcuguucaccggccccagcuccgccuucgucgugcagccgcagaacgggcgcugcaccaccgacggcgugcuccuggggaccacccagcucagccccgucaacaucugcacguuccggggcgacgugacccacaucaccggcucccgcaacuacaccaugaaccuggccagccagaacuggagcaacuacgaccccacggaggagaucccggcgccccuggggacccccgacuucgugggcaagauccaggggguccucacccagaccacgcggaccgacggcuccacccgcgggcacaaggccaccguguacacgggcagcgccgacuucgcccccaagcugggccgggugcaguucgagaccgacaccgaccacgacuucgagaccaaccagaacacgaaguucaccccggucggggugauccaggacggcuccaccacccaccgcaacgagccccagcagugggugcugcccagcuacuccgggcggaacacgcccaacguccaccucgccccggccguggcgcccaccuuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcgcuccugcgguucgugaaccccgacaccggccgcgugcuguucgagugcaagcuccacaaguccggguacgucaccguggcccacacgggccagcacgaccuggugaucccgcccaacggguacuuccgguucgacagcugggucaaccaguucuacacccuggcccccaugggcaacgggaccggccgccgccgguga

SEQ ID NO: 12475 - RNA, 1617 nt, Artificial Sequence
  derived and/or modified sequence opt1 from VP1__Norovirus_and/or_Norovirus-like__KJ678148
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccacgccccuggagaagcuguucaccggccccagcuccgccuucgucgugcagccgcagaacgggcgcugcaccaccgacggcgugcuccuggggaccacccagcucagccccgucaacaucugcacguuccggggcgacgugacccacaucaccggcucccgcaacuacaccaugaaccuggccagccagaacuggagcaacuacgaccccacggaggagaucccggcgccccuggggacccccgacuucgugggcaagauccaggggguccucacccagaccacgcggaccgacggcuccacccgcgggcacaaggccaccguguacacgggcagcgccgacuucgcccccaagcugggccgggugcaguucgagaccgacaccgaccacgacuucgagaccaaccagaacacgaaguucaccccggucggggugauccaggacggcuccaccacccaccgcaacgagccccagcagugggugcugcccagcuacuccgggcggaacacgcccaacguccaccucgccccggccguggcgcccaccuuccccggcgagcagcugcuguucuuccgcagcaccauccccgggugcuccggcuacccgaacauggaccucgacugccugcugccccaggagugggugcaguacuucuaccaggaggccgcccccgcccagagcgacgucgcgcuccugcgguucgugaaccccgacaccggccgcgugcuguucgagugcaagcuccacaaguccggguacgucaccguggcccacacgggccagcacgaccuggugaucccgcccaacggguacuuccgguucgacagcugggucaaccaguucuacacccuggcccccaugggcaacgggaccggccgccgccgguga

SEQ ID NO: 12476 - RNA, 1617 nt, Artificial Sequence
  derived and/or modified sequence opt1 from VP1__Norovirus_and/or_Norovirus-like__KP244316
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcagcaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgccuucgucgugcagccccagaacgggcgcugcacgaccgacggcguccuccuggggaccacccagcucagccccgugaacaucugcacguuccggggcgacgugacccacaucuccggcagccgcaacuacaccaugaaccuggccagccagaacuggaacuccuacgacccgaccgaggagauccccgcgccccuggggacgcccgacuucgucggcaagacccagggggugcucacccagaccacgaagaccaacggcagcacccgggggcacaaggccaccguguacacgggcuccgccgacuucagcccgaagcugggccgcguccaguucgccaccgacaccgacaacgacuucgagaccaaccagaacacgaaguucacccccgugggggugauccaggacggcuccaccacgccccgggacgagccccagcaguggguccugccgagcuacuccgggcgcaacacccacaacgugcaccucgcccccgccguggcccccaccuuccccggcgagcagcugcuguucuuccggagcaccaugccggggugcuccggcuaccccaacauggaccucgaccgccugcugccccaggaguggguccaguacuucuaccaggagcccgcgccggcccagagcgacguggcccuccugcgguucgugaaccccgacaccggccgcguccuguucgagugcaagcuccacaaguccggguacgugaccguggcccacacgggccagcacgaccuggucaucccgcccaacggguacuuccgguucgacagcugggugaaccaguucuacacccuggcgcccaugggcaacgggaccggccgccgccgguga

SEQ ID NO: 12477 - RNA, 1617 nt, Artificial Sequence
  derived and/or modified sequence opt1 from VP1__Norovirus_and/or_Norovirus-like__KF060072
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucuccggcagccgcaacuacaccaugaaccuggccagccagaacuggaacuccuacgaccccaccgaggagaucccggcgccccuggggacccccgacuucgucggcaagauccagggggugcucacgcagaccacccggaccgacggcagcacgcgcgggcacaaggccaccguguacaccggcuccgccgacuucagccccaagcugggccggguccaguucgccaccgacacggacaacgacuucaucaccaaccagaacaccaaguucaccccggugggggugauccaggacggcuccacgacgccccgcaacgagccccagcaguggguccugcccagcuacuccgggcggaacacccacaacgugcaccucgccccggccguggcgcccaccuuccccggcgagcagcugcuguucuuccgcagcaccaugcccgggugcuccggcuacccgaacauggaccucgacugccugcugccccaggaguggguccaguacuucuaccaggaggccgcccccgcccagagcgacguggcgcuccugcgguucgugaaccccgacaccggccgcguccuguucgagugcaagcuccacaagccgggguacgugaccguggcccacaccggccagcacgaccuggucaucccgcccaacggguacuuccgguucgacuccugggugaaccaguucuacacccuggcccccaugggcaacgggacgggccgccgccgguga

SEQ ID NO: 12478 - RNA, 1617 nt, Artificial Sequence
  derived and/or modified sequence opt1 from VP1__Norovirus_and/or_Norovirus-like__JX439822
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggcucccgccgcuga

SEQ ID NO: 12479 - RNA, 1617 nt, Artificial Sequence
  derived and/or modified sequence opt1 from VP1__Norovirus_and/or_Norovirus-like__KC463910
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagauccccgcgccccuggggacgcccgacuucgugggcaagauccaggggguccucacccagaccaccuccacgaacggcagcacccgcgggcacaaggccaccguguacaccggcuccgccgacuucagcccgaagcugggccgggugcaguucuccacggacaccaacaacgacuucgagaccaaccagaacaccaaguucacgcccgucggggugauccaggacggcagcaccacgccccgcaacgagccccagcagugggugcugccguccuacagcgggcggaacauccacaacguccaccucgcccccgccguggcccccaccuuccccggcgagcagcugcuguucuuccgcuccaccaugccggggugcagcggcuaccccaacauggaccucgacugccugcugccccaggagugggugcaguacuucuaccaggaggccgcgcccgcccaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcgcccaugggcaacgggacgggccgccggcgcuga

SEQ ID NO: 12480 - RNA, 1617 nt, Artificial Sequence
  derived and/or modified sequence opt1 from VP1__Norovirus_and/or_Norovirus-like__JX459651
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguucuccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12481 - RNA, 1617 nt, Artificial Sequence
  derived and/or modified sequence opt1 from VP1__Norovirus_and/or_Norovirus-like__AB541314
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgaggugguguucaccgucuccugccgcgugcugacccggcccagcccggacuucgacuucaucugccucgugccgcccaccgucgagucccgcaccaagcccuucacggugcccauccugaccguggaggagaugaccaacagccgguuccccaucccccuggagaagcuguucaccggccccuccagcgccuucgucgugcagccgcagaacgggcgcugcacgaccgacggcguccugcuggggaccacccagcucucccccgugaacaucugcacguuccggggcgacgugacccacaucgccggcagccgcaacuacaccaugaaccuggccucccugaacuggaacaacuacgaccccaccgaggagaucccggcgccccucgggacgcccgacuucgucggcaagauccagggggugcugacccagaccaccaagggcgacgggagcacgcggggccacaaggccaccguguacaccggcagcgcccccuucaccccgaagcugggguccguccaguucagcacggacaccgagaacgacuucgagacccaccagaacaccaaguucacgcccgugggcgugauccaggacgggggcaccacccaccgcaacgagccccagcaguggguccuccccuccuacagcgggcggaacgugccgaacgugcaccuggcccccgccgucgcgcccaccuuccccggcgagcagcuccucuucuuccgcuccacgaugccgggcugcagcggguaccccaacauggaccuggacugccugcucccccaggagugggugcagcacuucuaccaggaggccgcccccgcccaguccgacguggcgcugcugcgguucgucaacccggacaccggccgcguccucuucgagugcaagcugcacaagcccggguacgugaccguggcccacaccggccagcacgaccuggugauccccagcaacggguacuuccgguucgacuccugggugaaccaguucuacacccucgcccccaugggcaacggcacggggcgccggcgcuga

SEQ ID NO: 12482 - RNA, 1617 nt, Artificial Sequence
  derived and/or modified sequence opt1 from VP1__Norovirus_and/or_Norovirus-like__AB504323
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucaucgacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgaggacgucuucaccguguccugccgcgugcugacccggcccagccucgacuucgacuucaucuuccuggucccgcccaccguggagucccgcaccaagcccuucacggugcccauccugaccgucgaggagaugaccaacagccgguucccgaucccccucgagaagcuguucaccggccccuccggggccuucguggugcagccccagaacggccgcugcacgaccgacgggguccugcucggcaccacccagcugagcccggugaacaucugcacgcugcggggcgacgucacccacaucgccgggucccgcaacuacaccaugaaccucgccagccugaacuggaacaacuacgaccccaccgaggagauccccgcgccgcugggcacgcccgacuucguggggaagauccagggcgugcucacccagaccaccaagggggacggcuccacgcggggccacaaggccaccgucuacaccgggagcgcccccuucacccccaagcugggcagcgugcaguucuccacggacaccgagaacgacuucgagacccaccagaacaccaaguucacgccggugggggucauccaggacggcagcaccacccaccgcaacgagccccagcagugggugcugcccuccuacagcgggcggaacgugcacaacguccaccucgcccccgccguggcgccgaccuuccccggcgagcagcugcuguucuuccgcuccacgaugcccggcugcagcggguaccccaacauggaccucgacugccugcugccgcaggagugggugcagcacuucuaccaggaggccgcccccgcccaguccgacgucgcgcuccugcgguucgugaaccccgacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacggcacggggcgccggcgcuga

SEQ ID NO: 12483 - RNA, 1617 nt, Artificial Sequence
  derived and/or modified sequence opt1 from VP1__Norovirus_and/or_Norovirus-like__KX353963
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccaggacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12484 - RNA, 1617 nt, Artificial Sequence
  derived and/or modified sequence opt1 from VP1__Norovirus_and/or_Norovirus-like__KR904213
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuucagccuggcccccaugggcaacgggaccggccgccgccgguga

SEQ ID NO: 12485 - RNA, 1617 nt, Artificial Sequence
  derived and/or modified sequence opt1 from VP1__Norovirus_and/or_Norovirus-like__AB933745
augaagauggccagcaaccacgugaaccccuccgacggcagcaccgccaaccuggucccggaggugaacaacgaggugauggcgcucgagcccgucgugggggccgccaucgccgcccccguggcgggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggccggcaagaucaucuucgcggccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgccggcgacgacguguucaccgucuccugccgcgugcugacccggccgagccccgacuucgacuucaucuuccucgugccgcccaccgucgagucccgcacgaagcccuucagcgugcccgugcugaccgucgaggagaugaccaacucccgguuccccaucccccuggagaagcuguucaccggcccgagcuccgcguucgugguccagccccagaacgggcgcugcacgaccgacggcgugcuccuggggaccacccagcucagccccgugaacaucugcacguuccggggcgacgucacccacaucccgggcucccgcaacuacaccaugaaccuggccagccagaacuggaacuccuacgaccccaccgaggagauccccgcgccccuggggacgccggacuucgugggcaagauccagggggugcucacccagaccacccggacgaacggcagcacccgcgggcacaaggccaccgucuacaccggcagcgccgacuucucccccaagcugggccgggugcaguucgccacggacaccgacaacgacuucgagaccaaccagaacaccaaguucacgcccgugggggucauccaggacggcagcaccacgccccgcaacgagccgcagcagugggugcugcccuccuacagcgggcggaacauccacaacgugcaccucgcccccgccgucgcccccaccuucccgggcgagcagcugcuguucuuccgcuccaucaugcccgggugcagcggcuaccccaacauggaccucgacugccugcugccccaggagugggugcaguacuucuaccaggaggccgcgccggcccaguccgacguggcccuccugcgguucgucaaccccgacaccggccgcgugcuguucgagugcaagcuccacaagagcggguacgugaccgucgcccacaccggccagcacgaccuggugaucccgcccaacggguacuuccgguucgacuccugggugaaccaguucuacacccuggcgcccaugggcaacgggaccggccgccgccgguga

SEQ ID NO: 12486 - RNA, 1617 nt, Artificial Sequence
  derived and/or modified sequence opt1 from VP1__Norovirus_and/or_Norovirus-like__KP096341
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggagcaacuacgacccgaccgaggagauccccgcgccccuggggacgcccgacuucgugggcaagauccaggggaugcucacccagaccacccggacggacggcagcacccgcgggcacaaggccaccgucuacaucggcggcgccgacuucgccccgaagcuggggcgggugcaguucgagaccgacacggaccacgacuucgaggccaaccagaacaccaaguucacccccgugggcgucauccaggacggguccaccacgcaccgcaacgagccccagcagugggugcugcccagcuacuccggccggaacaccccgaacgugcaccucgcccccgcggucgcccccaccuuccccggggagcagcugcuguucuuccgcagcaccaugccgggcugcuccggcuaccccaacauggaccucgacugccugcugccccaggagugggugcaguacuucuaccaggaggccgcccccgcgcagagcgacguggcccuccugcgguucgucaacccggacacggggcgcgugcuguucgagugcaagcuccacaaguccggcuacgugaccgucgcccacaccgggcagcacgaccuggugaucccgcccaacggcuacuuccgguucgacagcugggugaaccaguucuacacccuggcccccauggggaacggcaccggccgccgccgguga

SEQ ID NO: 12487 - RNA, 1617 nt, Artificial Sequence
  derived and/or modified sequence opt1 from VP1__Norovirus_and/or_Norovirus-like__KM114291
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucgucccggcccccgggggcgaguucaccgugagcccccggaacgcgcccggggagauccugugguccgccccgcugggccccgaccucaaccccuaccugagccaccuggcccgcauguacaacggcuacgccgggggcuucgaggugcaggucauccucgccgggaacgcguucaccgccggcaaggugaucuucgccgccgugcccccgaacuuccccacggaggggcugucccccagccaggucaccauguucccccacaucgugguggacguccggcagcuggagccggugcucaucccccugcccgacgugcgcaacaacuucuaccacuacaaccaguccaacgaccccaccaucaagcugaucgccaugcucuacaccccgcugcgggcgaacaacgccggcgacgacgucuucacggugagcugccgcgugcugacccggcccucccccgacuucgacuucaucuuccucgugcccccgaccgucgagagccgcaccaagcccuucuccgugcccguccugacgguggaggagaugaccaacagccgguuccccaucccgcuggagaagcuguucaccggccccuccagcgccuucgucgugcagccccagaacgggcgcugcaccacggacggcgugcuccugggggccacccagcucuccccggucaacaucugcaccuuccggggcgacgugacccacaucacgggcagccgcaacuacaccaugaaccuggccucccagaacuggagcaacuacgaccccaccgaggagauccccgcgccccuggggaccccggacuucgugggcaagauccaggggguccucacgcagaccacccggaccgacggcagcacgcgcgggcacaaggccaccguguacaccggcuccgccgacuucgcccccaagcugggccgggugcaguucgagaccgacacggaccgcgacuucgaggccaaccagaacaccaaguucacccccgucggggugauccaggacggcagcaccacgcaccggaacgagccccagcagugggugcugccguccuacagcgggcgcaacacccccaacguccaccucgcgcccgccguggcccccaccuucccgggcgagcagcugcuguucuuccgguccaccaugcccgggugcagcggcuaccccaacauggaccucgacugccugcugccccaggagugggugcaguacuucuaccaggaggccgcgccggcccaguccgacgucgcccuccugcgcuucgugaaccccgacacgggccgggugcuguucgagugcaagcuccacaagagcggguacgucaccguggcccacaccggccagcacgaccuggugaucccgcccaacggguacuuccgcuucgacuccugggucaaccaguucuacacccuggcccccaugggcaacgggaccggccgccggcgcuga

SEQ ID NO: 12488 - RNA, 1617 nt, Artificial Sequence
  derived and/or modified sequence opt1 from VP1__Norovirus_and/or_Norovirus-like__KF060105
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacgugugcacguuccggggcgacgugacccacauccccggcucccacaacuacaccaugaaccuggccagccagaacuggaacagcuacgacccgaccgaggagauccccgcgccccuggggacgcccgacuucgucggcaagauccagggggugcucacccagaccaccuccacgaacggcagcacccgcgggcacaaggccaccguguacaccggcuccgccgacuucagcccgaagcugggccggguccaguucgccacggacaccaacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccggcgcuga

SEQ ID NO: 12489 - RNA, 1617 nt, Artificial Sequence
  derived and/or modified sequence opt1 from VP1__Norovirus_and/or_Norovirus-like__KF060081
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccacaacuacaccaugaaccuggccagccagaacuggaacagcuacgacccgaccgaggagauccccgcgccccuggggacgcccgacuucgucggcaagauccagggggugcucacccagaccaccuccacgaacggcagcacccgcgggcacaaggccaccguguacaccggcuccgccgacuucagcccgaagcugggccggguccaguucgccacggacaccaacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccggcgcuga

SEQ ID NO: 12490 - RNA, 1617 nt, Artificial Sequence
  derived and/or modified sequence opt1 from VP1__Norovirus_and/or_Norovirus-like__KF059999
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccgcaacuacaccaugaaccuggccucccagaacuggaacaacuacgacccgaccgaggagauccccgcgccccuggggacgcccgacuucgugggcaagauccaggggguccucacccagaccacccggacggacggcagcacccgcgggcacaaggccaccguguacaccggcagcgccgacuucgccccgaagcugggccgggugcaguucgagacggacaccgaccacgacuucgaggccaaccagaacaccaaguucacccccgucggggugauccaggacggcgggacgacccaccgcaacgagccccagcagugggugcugcccuccuacagcggccggaacacccacaacguccaccucgccccggcgguggcccccaccuuccccggggagcagcugcuguucuuccgcuccacgaugcccggcugcagcggcuacccgaacauggaccucgacugccugcugccccaggagugggugcaguacuucuaccaggagaccgcccccgcccaguccgacgucgcgcuccugcgguucgugaaccccgacaccgggcgcgugcuguucgagugcaagcuccacaagagcugcuacgucaccguggcccacaccggccagcacgaccuggugaucccgcccaacggguacuuccgguucgacuccugggucaaccaguucuacacgcuggcccccaugggcaacgggaccggccgccgccgguga

SEQ ID NO: 12491 - RNA, 1617 nt, Artificial Sequence
  derived and/or modified sequence opt1 from VP1__Norovirus_and/or_Norovirus-like__JX644036
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcaacgccuucgucgugcagccgcagaacgggcgcugcacgaccgacggcguccuccuggggaccacccagcucucccccgugaacaucugcacguuccggggcgacgugacccacauccccggcagccgcaacuacaccaugaaccuggccucccagaacuggaacagcuacgacccgaccgaggagauccccgcgccccuggggacgcccgacuucgucggcaagauccagggggugcucacccagaccacccggacgaacggcagcacccgcgggcacaaggccaccguguacaccggcuccgccgacuucagcccgaagcugggccggguccaguucgccacggacaccgacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12492 - RNA, 1617 nt, Artificial Sequence
  derived and/or modified sequence opt1 from VP1__Norovirus_and/or_Norovirus-like__JX459654
augaagauggccagcaacgacgccaaccccuccgacggcagcaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccucgacuucgacuucaucuuccuggugccgcccaccguggagucccgcacgaagcccuucagcguccccgugcugaccguggaggagaugaccaacucccgguuccccaucccccucgagaagcuguucaccggccccagcuccgccuucgucgugcagccgcagaacgggcgcugcacgaccgacggcguccugcucgggaccacccagcugagccccgugaacaucugcacguuccggggcgacgugauccacauccccggcucccgcaacuacaccaugaaccuggccagccagaacuggaacuccuacgacccgaccgaggagauccccgcgccccucgggacccccgacuucgucggcaagauccagggggugcugacgcagaccacccggaccaacggcagcacgcgcgggcacaaggccaccguguacaccggcagcgccgacuucuccccgaagcugggccggguccaguucgccaccgacacggacaacgacuucgagaccaaccagaacaccaaguucacccccgugggggugauccaggacggcagcacgacgccccgcaacgagccccagcaguggguccucccguccuacagcgggcggaacauccacaacgugcaccuggcccccgccguggcccccaccuuccccggcgagcagcuccuguucuuccgcuccaccaugccggggugcagcggcuaccccaacauggaccuggacugccugcucccccaggaguggguccaguacuucuaccaggaggcggcccccgcccaguccgacguggcccugcugcgguucgugaacccggacaccggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacgggaccggccgccgccgguga

SEQ ID NO: 12493 - RNA, 1617 nt, Artificial Sequence
  derived and/or modified sequence opt1 from VP1__Norovirus_and/or_Norovirus-like__JN400621
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcgucauguucgagugcaagcugcacaagagcggguacgugaccguggcgcacaccggccagcacgaccucgucaucccgcccaacggguacuuccgguucgacuccugggugaaccaguucuacacccuggcccccaugggcaacgggacgggccgccgccgguga

SEQ ID NO: 12494 - RNA, 1617 nt, Artificial Sequence
  derived and/or modified sequence opt1 from VP1__Norovirus_and/or_Norovirus-like__AB541260
augaagauggccagcaacgacgccaaccccuccgacggcagcgcggccaaccuggugcccgaggucaacaacgaggugauggcccucgagcccguggucggggccgccaucgcggcccccguggccgcccagcagaacgugaucgaccccuggauccgcaacaacuucguccaggcgccgggcggggaguucaccgugagcccccggaacgcccccuccgagauccugugguccgcgccccugggcccggaccucaaccccuaccugagccacuucgcccgcauguacaacugcuacgccgggggcuucgaggugcaggucauccuggccggcaacgccuucaccgccgggaagaucaucuucgccgccgugccgcccaacuuccccacggagggccucucccccagccaggugaccauguucccccacaucaucgucgacgugcggcagcuggagcccgugcugaucccgcuccccgacguccgcaacaacuucuaccacuacaaccaguccaacgacagcaccaucaagcugaucgcgaugcuguacacgccccuccgggccaacaacgccggggaggacguguucaccguguccugccgcguccugacccggcccagcccggacuucgacuucaucuuccuggugccgcccaccguggagucccgcaccaagcccuucacgguccccauccucaccguggaggagaugaccaacagccgguuccccaucccccuggagaagcuguucaccggccccuccagcgccuucgugguccagccgcagaacgggcgcugcacgaccgacggcgugcuccugggcaccacccagcugucccccgucaacaucugcacguuccgcggggacgugacccacaucgccggcagccggaacuacaccaugaaccucgcgucccugaacuggaacaacuacgaccccaccgaggagaucccggcgccccuggggacgcccgacuucgugggcaagauccagggcguccucacccagaccaccaagggggacggcagcacgcgggggcacaaggccaccguguacaccggcagcgcccccuucaccccgaagcugggguccgugcaguucagcacggacaccgagaacgacuucgagacccaccagaacaccaaguucacgcccgucggcgugauccaggacggcgggaccacccaccgcaacgagccccagcagugggugcugcccuccuacagcggccggaacgucccgaacgugcaccucgcccccgccguggcccccaccuuccccggggagcagcugcuguucuuccgcuccacgaugccgggcugcagcggguaccccaacauggaccucgacugccugcugccccaggaguggguccagcacuucuaccaggaggccgcccccgcgcaguccgacguggcccuccugcgguucgugaacccggacaccggccgcguccuguucgagugcaagcuccacaagagcggcuacgugaccguggcccacaccgggcagcacgaccuggucaucccgcccaacggcuacuuccgguucgacuccugggugaaccaguucuacacccuggcccccauggggaacggcacggggcgccggcgcuga

SEQ ID NO: 12495 - RNA, 1617 nt, Artificial Sequence
  derived and/or modified sequence opt1 from VP1__Norovirus_and/or_Norovirus-like__KX514341
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugacgguggaggagaugaccaacucccgguuccccgccacccuggacaagcuguucaccggccccagcuccacguucgucgugcagccccagaacgggcgcugcaugaucgacggcguccugcuggggaccacccagcucagcccggugaacaucugcaccuuccggggcgacgugacgcaguccggcaacaccaagaucuacaccaugaaccuggccagccccaacuggaacaacuacgaccccaccgaggagaucccggcgccccuggggacgcccgacuucgucggcaagauccaggggaugcucacccagaccaccaagggcgaggggagcacgcgcggccaccgggccaccguguacgugggcuccgccaacuacgcccccaagcuggggcgcguccaguucgagaccgacaccacggacgaccuggacgcccaccagaacaccaaguucaccccggugggcgugguccagagcggggagucccccaagggcagcgagccccagcagugggugcuccccuccuacagcgggcgggacaccccgaacgugcaccuggcccccgcggucgcccccacguuccccggcgagcagcuccucuucuuccgcuccaccaucccgggcugcgggggccaccccaacaugaaccuggacugccugcucccccaggagugggugcagcacuucuaccaggaggccgcccccgcgcagagcgacguggcccugcugcgguucgucaacccggacaccucccgcguccucuucgagugcaagcugcacaagagcggguacgugaccguggcccacacgggccagcacgaccuggugaucccgcccaacggguacuuccgguucgacuccugggugaaccaguucuacacccucgcccccaugggcaacggcaccgggcgcaagcgguga

SEQ ID NO: 12496 - RNA, 1617 nt, Artificial Sequence
  derived and/or modified sequence opt1 from VP1__Norovirus_and/or_Norovirus-like__KX514253
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccgggccucaaccccuaccugucccaccuggcccgcauguacaacggguacgccggcggguucgaggugcaggucauccucgccggcaacgccuucacggcggggaagaucaucuucgccgccgugccgcccaacuucccgaccgagggccugaaccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcagcaagcccuucuccguccccgugcugacggugcaggagaugaccaacagccgguuccccgccacccuggacaagcuguucaccgggcccuccagcaaccuggucgugcagccccagaacggccgcugcaugaucgacgggguccugcucggcacgacccagcuguccccggugaacaucugcaccuuccggggcgacgugacccaccuccgcgacagcacgaucuacaccaugaaccucgccucccccaacuggaacaacuacgaccccaccgaggagaucccggcgccccuggggacccccgacuucgucggcaagauccagggggugcugacgcagaccaccaagggcgaggggagcacccggggccaccgcgccacgguguacgucggcagcgccgacuacacccccaagcucgggaaggugcaguucgagaccaacaccacgaacgaccuguacgcccaccagaacaccaaguucaccccggugggcgucgugcagggcggggaguccgcccaccggagcgagccccagcagugggugcugcccggguacuccggccgcgacacccccaacguccaccucgccccggccguggcgcccacguuccccggcgagcagcugcuguucuuccggagcaccauccccgggugcggcgggcacccgaacauggaccucgacugccugcugccccaggagugggugcagcacuucuaccaggaggccgcccccgcccaguccgacgucgcgcuccugcgcuucgugaaccccgacaccagccgggugcuguucgagugcaagcuccacaaguccggcuacgucaccguggcccacacggggcagcacgaccuggugaucccgcccaacggcuacuuccgcuucgacagcugggucaaccaguucuacacccuggcccccaugggcaacgggaccggccggaagcgcuga

SEQ ID NO: 12497 - RNA, 1617 nt, Artificial Sequence
  derived and/or modified sequence opt1 from VP1__Norovirus_and/or_Norovirus-like__KX514195
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacuccuacgccggcggguucgaggugcaggucauccucgccggcaacgccuucaccgccgggaagaucaucuucgccgccgugccgcccacguucccgaccgagggccugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggggacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccaucaaccuggagcgccucuucaccggccccuccagcacgcuggugguccagccgcagaacgggcggugcaugaucgacggcgugcugcucgggaccacccagcugucccccgucaacaucugcaccuuccgcggcgacgugacgcacagccgggacagcaccaucuacaccaugaaccuggccucccccaacuggaacaacuacgacccgaccgaggagauccccgcgccccucggcacgcccgacuucguggggaagauccagggcguccugacccagaccaccaagggggagggcagcacgcgcgggcaccgggccaccguguacgugggcuccgccaacuacaccccgaagcugggcaagguccaguucgagaccaacacgaccaacgaccucuacgcccaccagaacacccgcuucacccccgugggggugguccagggcggggagagcgcccaccgguccgagccccagcagugggugcugcccagcuacuccggccgcgacacgccgaacgugcaccuggcccccgccgucgcccccaccuuccccggggagcagcuccuguucuuccggagcaccaucccgggcugcggcgggcaccccaacauggaccuggacugccuccugccccaggagugggugcagcacuucuaccaggaggcggcccccgcccaguccgacguggcccugcuccgcuucgucaacccggacaccagccgggugcuguucgagugcaagcugcacaaguccggcuacgugacggucgcgcacaccgggcagcacgaccucgugaucccgcccaacggcuacuuccgcuucgacagcugggugaaccaguucuacacccuggcccccauggggaacggcaccggccgcaagcgguga

SEQ ID NO: 12498 - RNA, 1617 nt, Artificial Sequence
  derived and/or modified sequence opt1 from VP1__Norovirus_and/or_Norovirus-like__KX354016
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcggcgugacccacauccccgggucccacaacuacaccaugaaccuggccagccagaacuggagcuccuacgacccgaccgaggagauccccgcgccccugggcacgcccgacuucguggggaagauccagggcguccucacccagaccaccagcacgaacggguccacccgcggccacaaggccaccguguacaccggcagcgccgacuucuccccgaagcuggggcgggugcaguucgccacggacaccaacaacgacuucgagaccaaccagaacaccaaguucacgcccgucggcgugauccaggacgggagcaccacgccccgcaacgagccccagcagugggugcugccguccuacagcggccggaacauccacaacguccaccucgcccccgccguggcccccaccuuccccggggagcagcugcuguucuuccgcuccaccaugccgggcugcagcggcuaccccaacauggaccucgacugccugcugccccaggagugggugcaguacuucuaccaggaggcggcccccgcccaguccgacgucgcccuccugcgguucgugaacccggacaccgggcgcgugcuguucgagugcaagcuccacaagagcggcuacgucaccguggcgcacaccgggcagcacgaccuggugaucccgcccaacggcuacuuccgguucgacuccugggucaaccaguucuacacccuggcccccauggggaacggcacgggccgccggcgcuga

SEQ ID NO: 12499 - RNA, 1617 nt, Artificial Sequence
  derived and/or modified sequence opt1 from VP1__Norovirus_and/or_Norovirus-like__KM245073
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccaccugaucgucgacgugcggcagcucgagcccgugcugaucccgcugcccgacguccgcaacaacuucuaccacuacaaccaguccaacgacagcaccaucaagcucaucgccaugcuguacacgccccugcgggccaacaacgcgggcgacgacguguucaccguguccugccgcguccucacccggcccagcccggacuucgacuucaucuuccuggugccgcccaccguggagucccgcacgaagcccuucagcguccccgugcugaccguggaggagaugaccaacucccgguuccccaucccccucgagaagcuguucaccggccccagcuccgccuucgucgugcagccgcagaacgggcgcugcacgaccgacggcguccugcucgggaccacccagcugagccccgugaacaucugcacguuccggggcgacgugacccacauccccggcucccgcaacuacaccaugaaccuggccagccagaacuggaacagcuacgacccgaccgaggagauccccgcgccccucgggacgcccgacuucgucggcaagauccagggggugcugacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccucccguccuacagcgggcggaacauccacaacgugcaccuggcccccgccguggcccccaccuuccccggcgagcagcuccuguucuuccgcuccaccaugccggggugcagcggcuaccccaacauggaccuggacugccugcucccccaggaguggguccaguacuucuaccaggaggcggcccccgcccaguccgacguggcccugcugcgguucgugaacccggacaccggccgcguccucuucgagugcaagcugcacaagagcggguacgugaccguggcgcacaccggccagcacgaccuggucaucccgcccaacggguacuuccgguucgacuccugggugaaccaguucuacacccucgcccccaugggcaacgggacgggccgccgccgguga

SEQ ID NO: 12500 - RNA, 1617 nt, Artificial Sequence
  derived and/or modified sequence opt1 from VP1__Norovirus_and/or_Norovirus-like__LN854567
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgacuucgucgugcagccccagaacgggcgcugcaccacggacggcgugcuccuggggaccacccagcucucccccgucaacaucugcaccuuccggggcgacgugacgcacaccaccggcagccgcaacuacaccaugaaccuggccucccagaacuggaacaacuacgacccgacggaggagacccccgcgccccuggggacccccgacuucgugggcaagauccgggggaugcucacccagacgacccgcgccgacggcagcacccgggggcacaaggccaccgucuacacgggcagcgccgacuucgccccgaagcugggccgcgugcaguucgagaccgacaccgacaacgacuucgacgccaaccagaacaccaaguucacgcccgugggggucauccaggacggcaccaccacccaccggaacgagccccgccagugggugcugcccuccuacagcgggcggaacacgcacaacgugcaccucgccccggcggucgcccccaccuuccccggcgagcagcugcuguucuuccgcuccaccaugcccgggugcagcggcuacccgaacauggaccucgacugccugcugccccaggagugggugcaguucuucuaccaggaggccgcccccgcgcaguccgacguggcccuccugcgguucgucaaccccgacaccggccgcgugcuguucgagugcaagcuccacaagagcggguacgugaccgucgcccacacgggcccgcacgaccuggugaucccgcccaacggguacuuccgcuucgacuccugggugaaccaguucuacacccuggcccccaugggcaacgggaccggccggcgccgguga

SEQ ID NO: 12501 - RNA, 1617 nt, Artificial Sequence
  derived and/or modified sequence opt1 from VP1__Norovirus_and/or_Norovirus-like__JN400619
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggccccgugcggggaguucaccgugagcccccggaacgcccccggcgagauccugugguccgcgccccuggggccggaccucaaccccuaccugagccaccuggcccgcauguacaacggcuacgccggcggguucgaggugcaggucauccucgccggcaacgccuucacggcggggaagaucaucuucgccgccgugccgcccaacuuccccaccgagggccugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggggacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacggccgcugcacgaccgacgggguccuccugggcaccacccagcucagccccgugaacaucugcacguuccgcggggacgugacccacauccccggcucccggaacuacaccaugaaccuggccagccagaacuggaacagcuacgacccgaccgaggagauccccgcgccccugggcacgcccgacuucgucgggaagauccagggcgugcucacccagaccacccggacgaacggguccacccgcggccacaaggccaccguguacaccgggagcgccgacuucuccccgaagcugggccggguccaguucgccacggacaccgacaacgacuucgagaccaaccagaacaccaaguucacgcccgugggcgugauccaggacgggagcaccacgccccgcaacgagccccagcaguggguccugccguccuacagcggccggaacauccacaacgugcaccucgcccccgccguggcccccaccuuccccggggagcagcugcuguucuuccgcuccaccaugccgggcugcagcggguaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggcuacgugaccguggcgcacaccgggcagcacgaccuggucaucccgcccaacggcuacuuccgguucgacuccugggugaaccaguucuacacccuggcccccauggggaacggcacggggcgccgccgguga

SEQ ID NO: 12502 - RNA, 1617 nt, Artificial Sequence
  derived and/or modified sequence opt1 from VP1__Norovirus_and/or_Norovirus-like__KF060052
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagauccccgcgccccuggggacgcccgacuucgugggcaagauccaggggguccucacccagaccaccuccacgaacggcagcacccgcgggcacaaggccaccguguacaccggcuccgccgacuucagcccgaagcugggccgggugcaguucgucacggacaccaacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggccgcgcccgcccagagcgacguggcccuccugcgguucgugaacccggacaccggccgcguccuguucgagugcaagcuccacaaguccggguacgugaccguggcccacaccggccagcacgaccuggucaucccgcccaacggguacuuccgguucgacagcugggugaaccaguucuacacccuggcgcccaugggcaacgggacgggccgccggcgcuga

SEQ ID NO: 12503 - RNA, 1617 nt, Artificial Sequence
  derived and/or modified sequence opt1 from VP1__Norovirus_and/or_Norovirus-like__KF060014
augaagauggccagcuccgacgccaaccccagcgacggcuccaccgcgaaccuggugcccgaggucagcaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacagcgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcagccacaacuacaccaugaaccuggccucccagaacuggaacagcuacgacccgaccgaggagauccccgcgccccuggggacgcccgacuucgugggcaagauccaggggguccucacccagaccaccuccacgaacggcagcacccgcgggcacaaggccaccguguacaccggcuccgccgacuucagcccgaagcugggccgggugcaguucgccacggacaccaacaacgacuucgagaccaaccagaacaccaaguucacgcccgucggggugauccaggacggcuccaccacgccccgcaacgagccccagcagugggugcugccgagcuacuccgggcggaacauccacaacguccaccucgcccccgccguggcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacgucgcccuccugcgguucgugaacccggacaccggccgcgugcuguucgagugcaagcuccacaaguccggguacaucaccgucgcgcacaccggccagcacgaccuggugaucccgcccaacggguacuuccgguucgacagcugggugaaccaguucuacacccuggcccccaugggcaacgggacgggccgccggcgcuga

SEQ ID NO: 12504 - RNA, 1617 nt, Artificial Sequence
  derived and/or modified sequence opt1 from VP1__Norovirus_and/or_Norovirus-like__KC517375
augaagauggccagcuccgacgccaaccccagcgacggcuccgcggccaaccuggugccggaggucaacaacgaggugauggcccucgagcccguggccggggccgcgaucgccgcccccgucgccggccagcagaacgugaucgaccccuggauccgcaacaacuucgugcaggcgcccgggggcgaguucaccgucagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgcgaugcucuacgcgccccugcgggccaacaacgccggcgacgacguguucaccgucagcugccgcgugcugacgcggccgucccccgacuucgacuucaucuuccucgugccgcccaccgucgagagccgcaccaagcccuucuccgugcccgugcugaccgucgaggagaugacgaacagccgguuccccaucccccuggagaagcuguucaccggcccguccagcgccuucgugguccagccccagaacgggcgcugcaccaccgacggcgugcuccuggggacgacccagcucucccccgugaacaucugcaccuuccggggcgacgucacccacaucacgggcagccgcaacuacaccaugaaccuggccucccagaacuggaacaacuacgacccgaccgaggagauccccgcgccccuggggacccccgacuucgugggcaagauccagggggugcucacgcagaccacccggaccgacggcagcacgcgcgggcacaaggccaccgucuacaccggcagcgccgacuucgccccgaagcugggccgggugcaguucgagaccgacacggaccacgacuucgaggccaaccagaacaccaaguucacccccgugggggucauccaggacggcgggaccacgcaccgcaacgagccccagcagugggugcugcccuccuacagcggccggaacacccacaacgugcaccucgccccggccgucgcccccaccuuccccggggagcagcugcuguucuuccgcuccaccaugcccggcugcagcggcuacccgaacauggaccucgacugccugcugccccaggagugggugcaguacuucuaccaggaggcggcccccgcccaguccgacguggcccuccugcgguucgucaaccccgacacggggcgcgugcuguucgagugcaagcuccacaagagcggcuacgugaccgucgcccacaccgggcagcacgaccuggugaucccgcccaacggcuacuuccgguucgacuccugggugaaccaguucuacacccuggcgcccauggggaacggcaccggccgccgccgguga

SEQ ID NO: 12505 - RNA, 1617 nt, Artificial Sequence
  derived and/or modified sequence opt1 from VP1__Norovirus_and/or_Norovirus-like__JX644039
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacaucuccggcagccgcaacuacaccaugaaccuggccagccagaacuggaccuccuacgaccccacggaggagaucccggcgccccuggggacccccgacuucgugggcaagauccaggggguccucacccagaccacgcggaccaacggcagcacccgcgggcacaaggccaccguguacacgggcuccgccgacuucagccccaagcugggccgggugcaguucgccaccgacaccgacaacgacuucgagaccaaccagaacacgaaguucaccccggucggggugauccaggacggcuccaccacgccccgcaacgagccccagcagugggugcugcccagcuacuccgggcggaacauccacaacguccaccucgccccggccguggcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacgucgcccuccugcgguucgugaaccccgacaccggccgcgugcuguucgagugcaagcuccacaaguccggguacgucaccguggcgcacaccggccagcacgaccuggugaucccgcccaacggguacuuccgguucgacagcugggucaaccaguucuacacgcuggcccccaugggcaacgggaccggccgccgccgguga

SEQ ID NO: 12506 - RNA, 1617 nt, Artificial Sequence
  derived and/or modified sequence opt1 from VP1__Norovirus_and/or_Norovirus-like__JX644031
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggagcuccuacgacccgaccgaggagauccccgcgccccuggggacgcccgacuucgucggcaagauccagggggugcucacccagaccacccggacgaacggcagcacccgcgggcacaaggccaccguguacaccggcuccgccgacuucagcccgaagcugggccggguccaguucgccacggacaccgacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12507 - RNA, 1617 nt, Artificial Sequence
  derived and/or modified sequence opt1 from VP1__Norovirus_and/or_Norovirus-like__HM191773
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacggcuacgccgggggcuucgaggugcaggucauccucgccgggaacgccuucacggccggcaagaucaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagaagcuguucaccggcccgagcuccgcguucgucgugcagccccagaacgggcgcugcacgaccgacggcguccuccuggggaccacccagcucagccccgugaacaucugcacguuccggggcgacgugacccacaucccgggcucccgcaacuacaccaugaaccuggccagccagaacuggaacagcuacgaccccaccgccgagauccccgcgccccuggggacgccggacuucgucggcaagauccagggggugcucacccagaccacccggacgaacggcuccacccgcgggcacaaggccaccguguacaccggcagcgccgacuucucccccaagcugggccggguccaguucgccacggacaccgacaacgacuucgagaccaaccagaacaccaaguucacgcccgugggggugauccaggacggcagcaccacgccccgcaacgagccgcagcaguggguccugcccuccuacagcgggcggaacauccacaacgugcaccucgcccccgccguggcccccaccuucccgggcgagcagcugcuguucuuccgcuccaccaugcccgggugcagcggcuaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggguacgugaccguggcgcacaccggccagcacgaccuggucaucccgcccaacggguacuuccgguucgacuccugggugaaccaguucuacacccuggcccccaugggcaacgggacgggccgccgccgguga

SEQ ID NO: 12508 - RNA, 1617 nt, Artificial Sequence
  derived and/or modified sequence opt1 from VP1__Norovirus_and/or_Norovirus-like__AB504309
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggguccucacccagacgacccgcggcgacggguccacccggggccacaaggccaccgugagcacgggcagcguggacuucaccccgaagcugggguccguccaguucgccaccgacaccgacaacgacuucgagacgggccagaacacccgcuucacccccgugggggugauccaggacggcagcuccgcccaccggaacgagccccagcaguggguccugcccgacuacagcgggcgcaccgugcacaacgugcaccucgccccggccgucgcccccacguuccccggcgagcagcugcuguucuuccgguucaccaugcccggcugcuccggguacccgaacauggaccucgacugccugcugccccaggagugggugcagcacuucuaccaggaggcggcccccgcccagagcgacguggcccuccugcgcuucgucaaccccgacaccggccgggugcuguucgagugcaagcuccacaagaccggguacgugaccgucgcgcacacgggccagcacgaccuggugaucccgcccaacggguacuuccgcuucgacuccugggugaaccaguucuacacccuggcccccaugggcaacggcgccgggcgccggcgcuga

SEQ ID NO: 12509 - RNA, 1617 nt, Artificial Sequence
  derived and/or modified sequence opt1 from VP1__Norovirus_and/or_Norovirus-like__KX514216
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccaccuccgcgacucccccaucuacacgaugaaccuggccagccccaacuggaacaacuacgacagcaccgaggagaucccggcgccccucggcacccccgacuucgucgggaagauccagggcgugcugacccagacgaccaagggggagggcuccacccgggggcaccgcgccaccguguacgucggcagcgccaacuacacgcccaagcugggcaaggugcaguucgagaccaacaccaccaacgaccucuacgcccaccagaacacgaaguucaccccggugggggucgugcagggcggggaguccgcccaccggagcgagccccagcagugggugcugcccggcuacuccgggcgcgacacccccaacguccaccuggccccggcgguggcccccaccuuccccggcgagcagcuccuguucuuccggagcacgauccccggcugcgggggccacccgaacauggaccuggacugccuccugccccaggagugggugcagcacuucuaccaggaggccgcccccgcgcaguccgacgucgcccugcuccgcuucgugaaccccgacaccagccgggugcuguucgagugcaagcugcacaaguccggguacgucaccguggcccacaccggccagcacgaccucgugaucccgcccaacggguacuuccgcuucgacagcugggucaaccaguucuacacgcuggcccccaugggcaacggcaccgggcggaagcgcuga

SEQ ID NO: 12510 - RNA, 1617 nt, Artificial Sequence
  derived and/or modified sequence opt1 from VP1__Norovirus_and/or_Norovirus-like__KX514212
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggagcucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccgugcaggagaugacgaacucccgguuccccgccacccuggacaagcuguucaccggccccagcuccaaccucgucgugcagccccagaacgggcgcugcaugaucgacggcguccugcucgggaccacgcagcugagcccggugaacaucugcaccuuccggggcgacgugacccacccccgcgacucccccaucuacaccaugaaccuggccagcccgaacuggaacaacuacgaccccacggaggagauccccgcgccccucggcaccccggacuucgucgggaagauccagggcgugcugacccagaccacgaagggggagggcagcacccgggggcaccgcgccaccguguacgucggcuccgccaacuacacccccaagcugggcaaggugcaguucgagacgaacaccaccaacgaccucuacgcccaccagaacaccaaguucacgcccgugggggucgugcagggcggggagagcgcccaccgguccgagccccagcagugggugcugccgggcuacagcgggcgcgacacccccaacguccaccuggcccccgcgguggcccccaccuucccgggcgagcagcuccuguucuuccgguccaccauccccggcugcgggggccaccccaacauggaccuggacugccuccugccccaggagugggugcagcacuucuaccaggaggccgccccggcgcagagcgacgucgcccugcuccgcuucgugaaccccgacacgucccgggugcuguucgagugcaagcugcacaagagcggguacgucaccguggcccacaccggccagcacgaccucgugaucccgcccaacggguacuuccgcuucgacuccugggucaaccaguucuacacccuggcccccaugggcaacggcacggggcggaagcgcuga

SEQ ID NO: 12511 - RNA, 1617 nt, Artificial Sequence
  derived and/or modified sequence opt1 from VP1__Norovirus_and/or_Norovirus-like__KX354138
augaagauggccagcuccgacgccaaccccagcgacggcuccgcggccaaccuggugccggaggccaacaacgaggucauggcccucgagcccguggugggggccgcgaucgccgcccccgucgccggccagcagaacgugaucgaccccuggauccgcaacaacuucgugcaggcgcccgggggcgaguucaccaucagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgucccgcccaacuucccgacggcggggcugucccccagccaggugaccauguuccccuccaucguggucgacgugcggcagcuggagcccgugcucaucccgcugcccgacguccgcaacaacuucuaccacuacaaccagagcaacgaccccaccaucacccugaucgccaugcucuacacgccccugcgggccaacaacgccggcgacgacguguucaccguguccugccgcguccugacccggccgagccccgacuucgacuucaucuuccucgugccgcccaccguggagucccgcacgaagcccuucagcguccccgugcugaccguggaggagaugaccaacucccgguuccccaucccccuggagcgccucuucaccggcccgagcuccgccuucgucgugcagccccagaacgggcggugcacgaccgacggcguccugcuggggaccacccagcucagccccgugaacaucugcacguuccgcggcgacaucacccacaucaccggcucccacaacuacaccaugaaccuggcgagccagaacuggaacaacuacgacccgacggaggagauccccgcgccccuggggacccccgacuucgugggcaagauccaggggguccucacccagaccacgcggggcgacgggagcacccgcggccacaaggccaccguguacaccggcuccgccgacuucagcccgaagcuggggcgggugcaguucgagacggacaccaaccacgacuucgaggccaaccagaacaccaaguucacccccgucggcgugauccaggacggguccacgacccaccgcaacgagccccagcagugggugcugcccagcuacuccggccggaacacccacaacguccaccucgccccggccguggcccccaccuuccccggggagcagcugcuguucuuccgcagcacgaugcccggcugcuccggcuacccgaacauggaccucgacugccugcugccccaggagugggugcaguacuucuaccaggaggccgcgcccgcccagagcgacgucgcccuccugcgguucgugaaccccgacaccgggcgcgugcuguucgagugcaagcuccacaaguccggcuacaucaccgucgcccacaccgggcagcacgaccuggugaucccgcccaacggcuacuuccgguucgacagcugggugaaccaguucuacacccuggcccccauggggaacggcacgggccgccgccgguga

SEQ ID NO: 12512 - RNA, 1617 nt, Artificial Sequence
  derived and/or modified sequence opt1 from VP1__Norovirus_and/or_Norovirus-like__AB933747
augaagauggccagcuccgacgccaaccccuucgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccugagccgcauguacaacggcuacgccgggggcuucgaggugcaggucauccucgccgggaacgccuucacggccggcaagaucaucuucgcggccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgccggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgcguucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccagaacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggccgcgccggcccagagcgacguggcccuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcgcccaugggcaacgggacgggccgccgccgguga

SEQ ID NO: 12513 - RNA, 1617 nt, Artificial Sequence
  derived and/or modified sequence opt1 from VP1__Norovirus_and/or_Norovirus-like__KJ955493
augaagauggccagcuccgacgccaaccccagcgacggcuccgcggccaaccuggugccggaggucaacaacgaggugauggcccucgagcccuucgugggggccgccaucgcggcccccgucgccggccagcagaacgugaucgaccccuggauccgcaacaacuucgugcaggcccccgggggcgaguucaccgucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgaccccaccaucaagcugaucgccaugcucuacacgccccugcgggcgaacaacgccggcgacgacguguucaccgucagcugccgcgugcugacccggccgucccccgacuucgacuucaucuuccucgugccgcccaccgucgagagccgcaccaagcccuucuccgugcccgugcugacggucgaggagaugaccaacagccgguuccccaucccccuggagaagcuguucaccggcccguccagcgccuucgugguccagccccagaacgggcgcugcaccacggacggcgugcugcuggggaccacccagcucucccccgugaacaucugcaccuuccggggcgacgucacgcacaucaccggcagccgcaacuacaccaugaaccuggccucccagaacuggaacaacuacgaccugaccgaggagaucccggcgccccucgggacgcccgacuucgugggcaagauccagggggugcugacccagaccacccggacggacggcagcacccgcgggcacaaggccaccgucuacaccggcagcgccgacuucgcccccaagcugggccgggugcaguucgagacggacaccgaccacgacuucgaggccaaccagaacaccaaguucaccccggugggggucauccaggacggcgggacgacccaccgcuccgagccccagcagugggugcuccccagcuacuccggccggaacacccccaacgugcaccuggccccggcggucgcccccaccuuccccggggagcagcuccucuucuuccgcagcacgaugcccggcugcuccggcuacccgaacauggaccuggacugccugcucccccaggagugggugcaguacuucuaccaggaggccgcccccgcgcagagcgacguggcccugcugcgguucgucaaccccgacaccgggcgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgccgccgguga

SEQ ID NO: 12514 - RNA, 1617 nt, Artificial Sequence
  derived and/or modified sequence opt1 from VP1__Norovirus_and/or_Norovirus-like__KJ678153
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccacgccccuggagaagcuguucaccggccccagcuccgccuucgucgugcagccgcagaacgggcgcugcaccaccgacggcgugcuccuggggaccacccagcucagccccgucaacaucugcacguuccggggcgacgugacccacaucaccggcucccgcaacuacaccaugaaccuggccagccagaacuggagcaacuacgaccccacggaggagaucccggcgccccuggggacccccgacuucgugggcaagauccaggggguccucacccagaccacgcggaccgacggcuccacccgcgggcacaaggccaccguguacaucggcagcgccgacuucgcccccaagcugggccgggugcaguucgagacggacaccgaccacgacuucgagaccaaccagaacaccaaguucacgccggucggggugauccaggacggcuccaccacccaccgcaacgagccccagcagugggugcugcccagcuacuccgggcggaacacccccaacguccaccucgccccggccguggcgcccacguuccccggcgagcagcugcuguucuuccgcagcacccuccccgggugcuccggcuacccgaacauggaccuggacugccugcucccccaggagugggugcaguacuucuaccaggaggccgcccccgcccagagcgacgucgcgcugcugcgguucgugaaccccgacaccggccgcguccucuucgagugcaagcugcacaaguccggguacgugaccguggcccacaccggccagcacgaccuggugaucccgcccaacggguacuuccgguucgacagcugggucaaccaguucuacacgcucgcccccaugggcaacgggaccggccgccgccgguga

SEQ ID NO: 12515 - RNA, 1617 nt, Artificial Sequence
  derived and/or modified sequence opt1 from VP1__Norovirus_and/or_Norovirus-like__KC456071
augaagauggccagcuccgacgccaacccgcccgacggcagcgcggccaaccuggugcccaaggucaacaacgaggugauggcccucgagcccguggucggggccgccaucgcggcccccguggccggccagcagaacgugaucgaccccuggaucaagaacaacuucguccaggcccccgggggcgaguucaccgugucccccaagaacgcgcccggggagauccuguggagcgccccgcugggccccgaccucaaccccuaccugucccaccuggcccgcauguacaacggcuacgccgggggcuucgaggugcaggucauccucgccgggaacgcguucaccgccggcaaggugaucuucgccgccgugcccccgaacuuccccacggaggggcugagccccucccaggucaccauguucccccacaucgugguggacguccggcagcuggagccggugcucaucccccugcccgacgugcgcaacaacuucuaccacuacaaccagagcaacgaccccaccaucaagcugaucgccaugcucuacaccccgcugcgggcgaacaacgccggcgacgacgucuucacgguguccugccgcgugcugacccggcccagccccgacuucgacuucaucuuccucgugcccccgaccgucgagucccgcaccaagcccuucagcgugcccguccugacgguggaggagaugaccaacucccgguuccccaucccgcuggagaagcuguucaccggccccagcuccgccuucgucgugcagccccagaacgggcgcugcaccacggacggcgugcuccuggggaccacccagcucagcccggucaacaucugcaccuuccggggcgacgugacgcacaucaccggcucccgcaacuacaccaugaaccuggccagccagaacuggaacaacuacgaccccaccgaggagauccccgcgccccuggggacgccggacuucgugggcaagauccaggggguccucacccagaccacccggacggacggcuccacccgcgggcacaaggccaccguguacaccggcagcgccgacuucgcccccaagcugggccgggugcaguucgagacggacaccgaccacgacuucgaggccaaccagaacaccaaguucacccccgucggggugauccaggacggcagcacgacccaccgcaacgagccccagcagugggugcugccguccuacagcgggcgggacacccacaacguccaccucgcccccgcgguggcccccaccuuccccggcgagcagcugcuguucuuccgcuccacgaugccggggugcagcggcuaccccaacauggaccucgacugccugcugccccaggagugggugcaguacuucuaccaggaggccgcccccgcgcaguccgacgucgcccuccugcgguucgugaacccggacaccggccgcgugcuguucgagugcaagcuccacaagagcggguacgucaccguggcccacaccggccagcacgaccuggugaucccgcccaacggguacuuccgguucgacuccugggucaaccaguucuacacccuggcccccaugggcaacgggacgggccgccggcgcuga

SEQ ID NO: 12516 - RNA, 1617 nt, Artificial Sequence
  derived and/or modified sequence opt1 from VP1__Norovirus_and/or_Norovirus-like__KC175384
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacugggacagcuacgaccccaccgaggagacgcccgcgccccuggggaccccggacuucgucggcaagauccagggggugcucacccagaccacgcggaccaacggcagcacccgcgggcacaaggccaccguguacacgggcuccgccgacuucagccccaagcugggccggguccaguucgccaccgacaccgacaacgacuucgagaccaaccagaacacgaaguucacccccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacgcuggcccccaugggcaacgggaccggccgccgccgguga

SEQ ID NO: 12517 - RNA, 1617 nt, Artificial Sequence
  derived and/or modified sequence opt1 from VP1__Norovirus_and/or_Norovirus-like__JQ613561
augaagauggccagcuccgacgccaaccccagcgacggcuccaccgcgaaccuggugccggaggucaacaccgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccacgaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcaccaagcccuucuccguccccgugcugaccguggaggagaugaccaacagccgguuccccaucccccuggagaagcuguucacgggcccguccagcgccuucgucgugcagccccagaacgggcgcugcaccaccgacggcguccuccuggggaccacgcagcucucccccgugaacaucugcaccuuccggggcgacgugacccacaucccgggcagccgcaacuacaccaugaaccuggccucccagaacuggaacagcuacgaccccacggaggagauccccgcgccccuggggaccccggacuucgucggcaagauccagggggugcucacccagaccacgcggaccaacggcagcacccgcgggcacaaggccaccguguacacgggcuccgccgacuucagccccaagcugggccggguccaguucgccaccgacaccgacaacgacuucgagaccaaccagaacacgaaguucacccccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacgccgcgcuccugcgguucgugaaccccgacaccggccgcgugcuguucgagugcaagcuccacaaguccggguacgucaccguggcccacaccggccagcacgaccuggugaucccgcccaacggguacuuccgguucgacagcugggucaaccaguucuacacgcuggcccccaugggcaacgggaccggccgccgccgguga

SEQ ID NO: 12518 - RNA, 1617 nt, Artificial Sequence
  derived and/or modified sequence opt1 from VP1__Norovirus_and/or_Norovirus-like__KJ678145
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcaccaagcccuucagcgugcccguccugacgguggaggagaugaccaacucccgguuccccacgccccuggagaagcuguucaccggccccagcuccgccuucgucgugcagccgcagaacgggcgcugcaccaccgacggcgugcuccuggggaccacccagcucagccccgucaacaucugcacguuccggggcgacgugacccacaucaccggcucccgcaacuacaccaugaaccuggccagccagaacuggagcaacuacgaccccacggaggagaucccggcgccccuggggacccccgacuucgugggcaagauccaggggguccucacccagaccacgcggaccgacggcuccacccgcgggcacaaggccaccguguacacgggcagcgccgacuucgcccccaagcugggccgggugcaguucgagaccgacaccgaccacgacuucgagaccaaccagaacacgaaguucaccccggucggggugauccaggacggcuccaccacccaccgcaacgagccccagcagugggugcugcccagcuacuccgggcggaacacgcccaacguccaccucgccccggccguggcgcccaccuuccccggcgagcagcugcuguucuuccgcagcaccaugcccgggugcuccggcuacccgaacauggaccucgacugccugcugccccaggagugggugcaguacuucuaccaggaggccgcccccgcccagagcgacgucgcgcuccugcgguucgugaaccccgacaccggccgcgugcuguucgagugcaagcuccacaaguccggguacgucaccguggcccacacgggccagcacgaccuggugaucccgcccaacggguacuuccgguucgagagcugggucaaccaguucuacacccuggcccccaugggcaacgggaccggccgccgccgguga

SEQ ID NO: 12519 - RNA, 1617 nt, Artificial Sequence
  derived and/or modified sequence opt1 from VP1__Norovirus_and/or_Norovirus-like__KF060116
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacgugacccacauccccggcucccacaacuacaccaugaaccuggccagccagaacuggaacagcuacgacccgaccgaggagacgcccgcgccccuggggacccccgacuucgugggcaagauccaggggguccucacccagaccacguccaccaacggcagcacccgcgggcacaaggccaccguguacacgggcuccgccgacuucagcccgaagcugggccgggugcaguucgccaccgacaccaacaacgacuucgagaccaaccagaacacgaaguucacccccgucggggugauccaggacggcuccaccacgccccgcaacgagccccagcagugggugcugccgagcuacuccgggcggaacauccacaacguccaccucgcccccgccguggcccccaccuuccccggcgagcagcugcuguucuuccgcagcaccaugccggggugcuccggcuaccccaacauggaccucgacugccugcugccccaggagugggugcaguacuucuaccaggaggcggcccccgcccagagcgacgucgcccuccugcgguucgugaacccggacaccggccgcgugcuguucgagugcaagcuccacaaguccggguacgucaccguggcgcacaccggccagcacgaccuggugaucccgcccaacggguacuuccgguucgacagcugggucaaccaguucuacacgcuggcccccaugggcaacgggaccggccgccggcgcuga

SEQ ID NO: 12520 - RNA, 1617 nt, Artificial Sequence
  derived and/or modified sequence opt1 from VP1__Norovirus_and/or_Norovirus-like__KC517362
augaagauggccagcuccgacgccaaccccagcgacggcuccgcggccaaccuggugccggaggucaacaacgaggugaucgcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacaucgcccacaucacgggcagccgcaacuacaccaugaaccuggccucccagaacuggaacaacuacgacccgaccgaggagauccccgcgccccuggggacccccgacuucgugggcaagauccagggggugcucacgcagaccacccggaccgacggcagcacgcgcgggcacaaggccaccgucuacaccggcagcgccgacuucgccccgaagcugggccgggugcaguucgagaccgacacggaccacgacuucgaggccaaccagaacaccaaguucacccccgugggggucauccaggacggcgggaccacgcaccgcaacgagccccagcagugggugcugcccuccuacagcggccggaacacccacaacgugcaccucgcgccggccgucgcccccaccuuccccggggagcagcugcuguucuuccgcuccaccaugcccggcugcagcggcuacccgaacauggaccucgacugccugcugccccaggagugggugcaguacuucuaccaggaggccgcgcccgcccaguccgacguggcccuccugcgguucgucaaccccgacacggggcgcgugcuguucgagugcaaccuccacaagagcggcuacgugaccgucgcccacaccgggcagcacgaccuggugaucccgcccaacggcuacuuccgguucgacuccugggugaaccaguucuacacccuggcccccauggggaacggcaccggccgccgccgguga

SEQ ID NO: 12521 - RNA, 1617 nt, Artificial Sequence
  derived and/or modified sequence opt1 from VP1__Norovirus_and/or_Norovirus-like__JX644038
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacgugugcacguuccggggcgacgugacccacaucuccggcagccgcaacuacaccaugaaccuggccagccagaacuggaccuccuacgaccccacggaggagaucccggcgccccuggggacccccgacuucgucggcaagauccagggggugcucacccagaccacgcggaccaacggcagcacccgcgggcacaaggccaccguguacacgggcuccgccgacuucagccccaagcugggccggguccaguucgccaccgacaccgacaacgacuucgagaccaaccagaacacgaaguucaccccggugggggugauccaggacggcuccaccacgccccgcaacgagccccagcaguggguccugcccagcuacuccgggcggaacauccacaacgugcaccucgccccggccguggcccccaccuuccccggcgagcagcugcuguucuuccgcagcaccaugcccgggugcuccggcuacccgaacauggaccucgacugccugcugccccaggaguggguccaguacuucuaccaggaggcggcccccgcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacgcuggcccccaugggcaacgggaccggccgccgccgguga

SEQ ID NO: 12522 - RNA, 1617 nt, Artificial Sequence
  derived and/or modified sequence opt1 from VP1__Norovirus_and/or_Norovirus-like__AB504313
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcugcuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgacccgcggcgacgggcugacccggggccacaaggccaccgucuccacgggcagcguggacuucaccccgaagcuggggagcgugcaguucgccaccgacaccgacaacgacuucgagacgggccagaacacccgcuucacccccgucggggugauccaggacggcuccagcgcccaccggaacgagccccagcagugggugcuccccgacuacuccgggcgcaccguccacaacgugcaccuggccccggccguggcccccacguuccccggcgagcagcuccucuucuuccggagcaccaugcccggcugcuccggguacccgaacauggaccuggacugccugcucccccaggaguggguccagcacuucuaccaggaggcggcccccgcccagagcgacguggcccugcugcgcuucguggaccccgacaccggccggguccucuucgagugcaagcugcacaagaccggguacgugaccguggcgcacacgggccagcacgaccuggucaucccgcccaacggguacuuccgcuucgacuccugggugaaccaguucuacacccucgcccccaugggcaacggcgccgggcgccggcgcuga

SEQ ID NO: 12523 - RNA, 1617 nt, Artificial Sequence
  derived and/or modified sequence opt1 from VP1__Norovirus_and/or_Norovirus-like__KX514361
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacuccaagaucuacacgaugaaccuggccagccccaacuggaacaacuacgacccgaccgaggagauccccgcgccccugggcacccccgacuucgucgggaagauccagggcaugcucacccagacgaccaagggggagggcagcacccgggggcaccgcgccaccguguacgugggcuccgccaacuacgccccgaagcugggccggguccaguucgagacggacaccaccgacgaccuggacgcccaccagaacaccaaguucacgcccgugggggugguccagggcggggagagccccaagggcuccgagccccagcagugggugcucccgagcuacuccgggaaggacacccccaacgugcaccuggcccccgcggucgcccccaccuucccgggcgagcagcuccucuucuuccgcagcaccauccccggcugcgggggccaccccaacaugaaccuggacugccugcucccccaggagugggugcagcacuucuaccaggaggccgccccggcgcaguccgacguggcccugcugcgguucgucaaccccgacacgagccgcguccucuucgagugcaagcugcacaaguccggguacgugaccguggcccacaccggccagcacgaccuggugaucccgcccaacggguacuuccgguucgacagcugggugaaccaguucuacacccucgcccccaugggcaacggcacggggcgcaagcgguga

SEQ ID NO: 12524 - RNA, 1617 nt, Artificial Sequence
  derived and/or modified sequence opt1 from VP1__Norovirus_and/or_Norovirus-like__KX514336
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacuccggcaacagcaagaucuacacgaugaaccuggccagccccaacuggaacaacuacgaccccaccgaggagaucccggcgccccuggggacccccgacuucgucggcaagauccaggggaugcucacccagacgaccaagggcgagggguccacccgcggccaccgggccaccguguacgugggcagcgccaacuacgcccccaagcuggggcgcguccaguucgagacggacaccaccgacgaccuggacgcccaccagaacaccaaguucacgccggugggcgugguccagggcggggagucccccaaggggagcgagccccagcagugggugcuccccuccuacagcggccgggacaccccgaacgugcaccuggcccccgcggucgcccccaccuuccccggcgagcagcuccucuucuuccgcuccaccaucccggggugcggcgggcaccccaacaugaaccuggacugccugcucccccaggagugggugcagcacuucuaccaggaggccgcccccgcgcagagcgacguggcccugcugcgguucgucaacccggacacgucccgcguccucuucgagugcaagcugcacaagagcggcuacgugaccguggcccacaccgggcagcacgaccuggugaucccgcccaacggcuacuuccgguucgacuccugggugaaccaguucuacacccucgcccccaugggcaacgggacgggccgcaagcgguga

SEQ ID NO: 12525 - RNA, 1617 nt, Artificial Sequence
  derived and/or modified sequence opt1 from VP1__Norovirus_and/or_Norovirus-like__KX514203
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcagcaagcccuucuccguccccgugcugacggugcaggagaugaccaacagccgguuccccgccacccuggacaagcuguucaccggccccuccagcacgcucgucgugcagccgcagaacgggcgcugcaugaucgacggcguccugcucgggaccacccagcugucccccgugaacaucugcaccuuccggggcgacgugacgcacagccgcgacagcaccaucuacaccaugaaccuggccucccccaacuggaacaacuacgacccgaccgaggagauccccgcgccccucggcacgcccgacuucgucgggaagauccagggcgugcugacccagaccaccaagggggagggcagcacgcgggggcaccgcgccaccguguacgucggcuccgccaacuacaccccgaagcugggcaaggugcaguucgagaccaacacgaccaacgaccucuacgcccaccagaacacccgguucacccccgugggggucgugcagggcggggagagcgcccaccgcuccgagccccagcagugggugcugcccagcuacuccggccgggacacgccgaacguccaccuggcccccgccguggcgcccaccuuccccggggagcagcuccuguucuuccgcagcaccaucccgggcugcggcgggcaccccaacauggaccuggacugccuccugccccaggagugggugcagcacuucuaccaggaggccgcccccgcccaguccgacgucgcgcugcuccgguucgugaacccggacaccagccgcgugcuguucgagugcaagcugcacaaguccggcuacgucacgguggcccacaccgggcagcacgaccucgugaucccgcccaacggcuacuuccgguucgacagcugggucaaccaguucuacacccuggcccccauggggaacggcaccggccgcaagcgcuga

SEQ ID NO: 12526 - RNA, 1617 nt, Artificial Sequence
  derived and/or modified sequence opt1 from VP1__Norovirus_and/or_Norovirus-like__KP784693
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgagggcguccuccuggggaccacccagcucagccccgugaacaucugcacguuccggggcgacgugacccacaucuccggcagccgcaacuacaccaugaaccuggccagccagaacuggaacuccuacgaccccaccgaggagaucccggcgccccuggggacgcccgacuucgucggcaagauccagggggugcucacccagaccacccggacggacggcagcacccgcgggcacaaggccaccguguacaccggcuccgccgacuucagccccaagcugggccggguccaguucgccacggacaccgacaacgacuucgugaccaaccagaacaccaaguucacgccggugggggucauccaggacggcuccaccacgccccgcaacgagccccagcagugggugcugcccagcuacuccgggcggaacacccacaacgugcaccucgccccggccgucgcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacguggcccuccugcgguucgucaaccccgacaccggccgcgugcuguucgagugcaagcuccacaaguccggguacgugaccgucgcgcacaccggccagcacgaccuggugaucccgcccaacggguacuuccgguucgacagcugggugaaccaguucuacacgcuggcccccaugggcaacggggccggccgccgccgguga

SEQ ID NO: 12527 - RNA, 1617 nt, Artificial Sequence
  derived and/or modified sequence opt1 from VP1__Norovirus_and/or_Norovirus-like__AB933734
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggaguccgagacgaagcccuucuucuuccccguccugaccguggaggagaugaccaacagccgcuuccccaucccccuggagaagcuguucaccggccccuccagcgccuucgugguccagccgcagaacgggcggugcacgaccgacggcgugcuccuggggaccacccagcucucccccgucaacaucugcacguuccgcggcgacgugacccacauccccggcagccggaacuacaccaugaaccuggccucccagaacuggaacagcuacgacccgaccgaggagauccccgcgccccuggggacgcccgacuucgugggcaagauccaggggguccucacccagaccacccgcacgaacggcagcacccgggggcacaaggccaccguguacaccggcuccgccgacuucagcccgaagcugggccgcgugcaguucgccacggacaccgacaacgacuucgagaccaaccagaacaccaaguucacgcccgucggggugauccaggacggcuccaccacgccccggaacgagccccagcagugggugcugccgagcuacuccgggcgcaacauccacaacguccaccucgcccccgccguggcccccaccuuccccggcgagcagcugcuguucuuccggagcaccaugccggggugcuccggcuaccccaacauggaccucgacugccugcugccccaggagugggugcaguacuucuaccaggaggcggcccccgcccagagcgacgucgcccuccugcgcuucgugaacccggacaccggccgggugcuguucgagugcaagcuccacaaguccggguacgucaccguggcgcacaccggccagcacgaccuggugaucccgcccaacggguacuuccgcuucgacagcugggucaaccaguucuacacccuggcccccaugggcaacgggacgggccggcgccgcuga

SEQ ID NO: 12528 - RNA, 1617 nt, Artificial Sequence
  derived and/or modified sequence opt1 from VP1__Norovirus_and/or_Norovirus-like__KF060041
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucggggugcaggucauccucgccggcaacgccuucaccgccgggaaggugaucuucgccgccgugccgcccaacuucccgacggagggccugucccccagccaggucaccauguucccccacaucguggugaacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccgggccguccagcgccuucgucgugcagccccagaacggccgcugcaccacggacggggugcuccugggcaccacccagcucucccccgucaacaucugcaccuuccggggcgacgugacgcacaucaccgggagccgcaacuacaccaugaaccuggccucccagaacuggaacaacuacgacccgaccgaggagacgcccgcgccccugggcacccccgacuucguggggaagauccagggcguccucacccagaccacgcggaccgacgggagcacccgcggccacaaggccaccguguacacgggcagcgccgacuucgccccgaagcuggggcgggugcaguucgagaccgacaccgaccacgacuucgaggccaaccagaacaccaaguucacgcccgucggcgugauccaggacggguccaccacccaccgcaacgagccccagcagugggugcugcccagcuacuccggccggaacacccacaacguccaccucgccccggcgguggcccccacguuccccggggagcagcugcuguucuuccgcagcaccaugcccggcugcuccggcuacccgaacauggaccucgacugccugcugccccaggagugggugcaguacuucuaccaggaggccgcccccgcgcagagcgacgucgcccuccugcgguucgugaaccccgacaccgggcgcgugcuguucgagugcaagcuccacaaguccggcuacgucaccguggcccugaccgggcagcacgaccuggugaucccgcccaacggcuacuuccgguucgacagcugggucaaccaguucuacacgcucgcccccauggggaacggcaccggccgccgccgguga

SEQ ID NO: 12529 - RNA, 1617 nt, Artificial Sequence
  derived and/or modified sequence opt1 from VP1__Norovirus_and/or_Norovirus-like__JX989074
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagacgcccgcgccccuggggacccccgacuucgucggcaagauccagggggugcucacccagaccacgcggaccaacggcuccacccgcgggcacaaggccaccguguacacgggcagcgccgacuucuccccgaagcugggccggguccaguucgccaccgacaccgacaacgacuucgagaccaaccagaacacgaaguucacccccgugggggugauccaggacggcagcaccacgccccgcaacgagccccagcaguggguccugccguccuacagcgggcggaacauccacaacgugcaccucgcccccgccguggcccccaccuuccccggcgagcagcugcuguucuuccgcuccaccaugccggggugcagcggcuaccccaacauggaccucgacugccugcugccccaggaguggguccaguacuucuaccaggaggcggcccccgcccaguccgacguggcccuccugcgguucgugaacccggacaccggccgcguccuguucgagugcaagcuccacaagagcggguacgugaccguggcgcacaccggccagcacgaccuggucaucccgcccaacggguacuuccgguucgacuccugggugaaccaguucuacacgcuggcccccaugggcaacgggaccggccgccgccgguga

SEQ ID NO: 12530 - RNA, 1617 nt, Artificial Sequence
  derived and/or modified sequence opt1 from VP1__Norovirus_and/or_Norovirus-like__JN400624
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgaccgcugcacgaccgacgggguccuccugggcaccacccagcucucccccgugaacaucugcacguuccgcggggacgugacccacaucccgggcagccggaacuacaccaugaaccuggccucccagaacuggaacagcuacgaccccaccgaggagauccccgcgccccugggcacgccggacuucgucgggaagauccagggcgugcucacccagaccacccggacgaacgggagcacccgcggccacaaggccaccguguacaccggguccgccgacuucagccccaagcugggccggguccaguucgccacggacaccgacaacgacuucgagaccaaccagaacaccaaguucacgcccgugggcgugauccaggacggguccaccacgccccgcaacgagccgcagcaguggguccugcccagcuacuccggccggaacauccacagcgugcaccucgcccccgccguggcccccaccuucccgggggagcagcugcuguucuuccgcuccaccaugcccggcugcagcggguaccccaacauggaccucgacugccugcugccccaggaguggguccaguacuucuaccaggaggcggccccggcccaguccgacguggcccuccugcgguucgugaaccccgacaccggccgcguccuguucgagugcaagcuccacaagagcggcuacgugaccguggcgcacaccgggcagcacgaccuggucaucccgcccaacggcuacuuccgguucgacuccugggugaaccaguucuacacccuggcccccauggggaacggcacggggcgccgccgguga

SEQ ID NO: 12531 - RNA, 1617 nt, Artificial Sequence
  derived and/or modified sequence opt1 from VP1__Norovirus_and/or_Norovirus-like__EU876894
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgacccccgcauccggaacaacuucguccaggcccccgggggcgaguucaccgugagcccccgcaacgcccccggggagauccugugguccgcgccccugggcccggaccucaaccccuaccugagccaccuggcccggauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcgccagcuggagcccgugcucaucccgcugcccgacguccggaacaacuucuaccacuacaaccagagcaacgaccccaccaucaagcugaucgccaugcucuacacgccccugcgcgccaacaacgcgggggacgacguguucaccguguccugcuggguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggagcgacgggagcacccggggccacaaggccaccguguccaccgggagcgugcacuucacgccgaagcugggccgcauccaguucuccaccgacaccagcaacgacuucgagaccggccagaacacgcgguucacccccgucgggguggugcaggacggcuccaccacccaccagaacgagccccagcaguggguccugcccaacuacagcgggcgcgacucccacaacgugcaccucgccccggccguggcccccagcuuccccggcgagcagcugcuguucuuccgguccacgaugcccgggugcagcggcuacccgaacaugaaccucgacugccugcugccccaggaguggguccagcacuucuaccaggaggccgcgcccgcccaguccgacguggcccuccugcgcuucgugaaccccgacaccggccggguccuguucgagugcaagcuccacaagagcggguacgugaccguggcccacaccggccagcacgaccuggucaucccgcccaacggguacuuccgcuucgacuccugggugaaccaguucuacacccuggcgcccaugggcaacgggacgggccggcgccgcuga

SEQ ID NO: 12532 - RNA, 1617 nt, Artificial Sequence
  derived and/or modified sequence opt1 from VP1__Norovirus_and/or_Norovirus-like__KX514173
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccgugaaccuggagcgccucuucacggggcccagcuccgcgaacgucgugcagccgcagaacggccggugcaccaucgacggggagcugcugggcaccacccagcucagcuccgucaacaucugcacguuccgcggcgacgugacccacaucgggaccacccggcacuggacgaugaaccuggccagccccaacuggaacaacuacgaccccaccgaggagaccccggcgccccugggcacccccgacuucguggggaagauccagggcaugcucacgcagaccaccaagggggagggcagcacccgcggccaccgggccacggucuacgugggguccgccaacuacgcccccaagcugggccgcgugcaguucgagaccgacaccaccaacgaccuggacgcccaccagaacacgaaguucaccccggucgggguggugcagggcggggagagccccaagggcuccgagccccagcaguggguccuccccagcuacuccggccgggacaccccgaacgugcaccuggcccccgccguggcccccaccuuccccggggagcagcuccuguucuuccgcagcacgaucccgggcugcgggggccaccccaacaugaaccuggacugccugcucccccaggaguggguccagcacuucuaccaggaggcggcccccgcccaguccgacguggcccugcugcgguucgugaacccggacaccagccgcguccucuucgagugcaagcugcacaaguccggguacgugaccguggcgcacaccggccaguacgaccugguccuccccagcaacggcuacuuccgguucgacuccugggugaaccaguucuacacccuggcccccauggggaacggcacggggcgccgccgguga

SEQ ID NO: 12533 - RNA, 1617 nt, Artificial Sequence
  derived and/or modified sequence opt1 from VP1__Norovirus_and/or_Norovirus-like__KX353989
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauggucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggccaacaacgcgggcgacgacguguucaccgucuccugccgcgugcugacccggcccagcccggacuucgacuucaucuuccucgugccgcccaccgucgagucccgcacgaagcccuucagcgugcccauccugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccacaacuacaccaugaaccuggccagccagaacuggaacagcuacgacccgaccgaggagauccccgcgccccuggggacgcccgacuucgucggcaagauccagggggugcucacccagaccaccuccacgaacggcagcacccgcgggcacaaggccaccguguacaccggcuccgccgacuucagcccgaagcugggccggguccaguucgccacggacaccaacaacgacuucgagaccaaccagaacaccaaguucacgcccgugggggugauccaggacggcuccaccacgccccgcaacgagccccagcaguggguccugccgagcuacuccgggcggaacauccacaacgugcaccucgcccccgccguggcccccaccuuccccggcgagcagcugcuguucuuccgcagcaccaugccggggugcuccggcuaccccaacauggaccucgacugccugcugccccaggaguggguccaguacuucuaccaggaggcggcccccgcccagagcgacguggcccuccugcgguucgugaacccggacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccggcgcuga

SEQ ID NO: 12534 - RNA, 1617 nt, Artificial Sequence
  derived and/or modified sequence opt1 from VP1__Norovirus_and/or_Norovirus-like__KX353962
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacccccgguuccccaucccccuggagaagcuguucaccggcccguccagcgccuucgucgugcagccccagaacgggcgcugcacgaccgacggcguccuccuggggaccacccagcucucccccgugaacaucugcacguuccggggcgacgugacccacaucccgggcagccgcaacuacaccaugaaccuggccucccagaacuggaacagcuacgaccccaccgaggagauccccgcgccccuggggacgccggacuucgucggcaagauccagggggugcucacccagaccacccggacgaacggcagcacccgcgggcacaaggccaccguguacaccggcuccgccgacuucagccccaagcugggccggguccaguucgccacggacaccgacaacgacuucgagaccaaccaggacaccaaguucacgcccgugggggugauccaggacggcuccaccacgccccgcaacgagccgcagcaguggguccugcccagcuacuccgggcggaacauccacaacgugcaccucgcccccgccguggcccccaccuucccgggcgagcagcugcuguucuuccgcagcaccaugcccgggugcuccggcuaccccaacauggaccucgacugccugcugccccaggaguggguccaguacuucuaccaggaggcggccccggcccagagcgacguggcccuccugcgguucgugaaccccgacaccggccgcguccuguucgagugcaagcuccacaaguccggguacgugaccguggcgcacaccggccagcacgaccuggucaucccgcccaacggguacuuccgguucgacagcugggugaaccaguucuacacccuggcccccaugggcaacgggacgggccgccgccgguga

SEQ ID NO: 12535 - RNA, 1617 nt, Artificial Sequence
  derived and/or modified sequence opt1 from VP1__Norovirus_and/or_Norovirus-like__AB972515
augaagauggccagcuccgacgccaaccccagcgacggcuccaccgcgaaccuggugcccgaggucaacaacgaggugauggcccucgagcccgugaucggggccgccaucgccgcgcccgucgccggccagcagaacgugaucgaccccuggauccgcaacaacuucgugcaggcccccgggggcgaguucaccgucagcccccggaacgcccccggggagauccugugguccgcgccccugggcccggaccucaaccccuaccugagccaccugucccgcauguacaacggcuacgccgggggcuucgagguccaggugauccucgccgggaacgccuucacggccggcaagaucaucuucgcggccgugccgcccaacuucccgaccgaggggcugagccccucccaggugaccauguucccccacaugaucguggacguccggcagcuggagcccgugcucaucccgcugcccgacgugcgcaacaacuucuaccacuacaaccagagcaacgacuccaccaucaagcugaucgccaugcucuacacgccccugcgggccaacaacgccggcgacgacgucuucaccgugagcugccgcgugcugacccggcccuccccggacuucgacuucaucuuccucgucccgcccaccguggagagccgcacgaagcccuucuccgugcccguccugaccguggaggagaugaccaacagccgguuccccaucccccuggagaagcuguucaccggccccuccagcgcguucgugguccagccgcagaacgggcgcugcacgaccgacggcgugcuccuggggaccacccagcucucccccgucaacaucugcacguuccggggcgacgugacccacauccccggcagccgcaacuacaccaugaaccuggccagccagaacuggaacuccuacgacccgaccgaggagauccccgcgccccuggggacgcccgacuucgugggcaagauccaggggguccucacccagaccacccggacgaacggcagcacccgcgggcacaaggccaccguguacaccggcuccgccgacuucagcccgaagcugggccgggugcaguucgccacggacaccgacaacgacuucgagaccaaccagaacaccaaguucacgcccgucggggugauccaggacggcuccaccacgccccgcaacgagccccagcagugggugcugccgagcuacuccgggcggaacauccacaacguccaccucgcccccgccguggcccccaccuuccccggcgagcagcugcuguucuuccgcagcaccaugccggggugcuccggcuaccccaacauggaccucgacugccugcugccccaggagugggugcaguacuucuaccaggaggccgcgcccgcccagagcgacgucgcccuccugcgguucgugaacccggacaccggccgcgugcuguucgagugcaagcuccacaaguccggguacgucaccguggcccacaccggccagcacgaccuggugaucccgcccaacggguacuuccgguucgacagcugggucaaccaguucuacacccuggcgcccaugggcaacgggacgggccgccgccgguga

SEQ ID NO: 12536 - RNA, 1617 nt, Artificial Sequence
  derived and/or modified sequence opt1 from VP1__Norovirus_and/or_Norovirus-like__KT033904
augaagauggccagcaacgacgccaaccccuccgacggcagcgcggccaaccuggugcccaaggucaacaacgaggugauggcccucgagcccguggucggggccgccaucgcggcccccguggccggccagcagaacgugaucgaccccuggaucaagaacaacuucguccaggcccccgggggcaaguucaccgugucccccaagaacgcgcccggggagauccuguggagcgcgccccugggcccggaccucaaccccuaccugucccaccuggcccgcauguacaagggccacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcugcuggggaccacccagcucagccccgucaacaucugcacguuccggggcgacgugacccacaucgccggcucccgcaacuacaccaugaaccuggccagccugaacuggaacaacuacgaccccaccgaggagaucccggcgccccucgggacgcccgacuucgugggcaagauccaggggguccugacccagaccaccaagggcgacggguccacgcggggccacaaggccaccguguacaccggcagcgcccccuucaccccgaagcuggggagcgugcaguucuccacggacaccgagaacgacuucgagacccaccagaacaccaaguucacgcccgucggcgugauccaggacgggggcaccacccaccgcaacgagccccagcagugggugcuccccagcuacuccgggcggaacgucccgaacgugcaccuggcccccgccguggcgcccaccuuccccggcgagcagcuccucuucuuccgcagcacgaugccgggcugcuccggguaccccaacauggaccuggacugccugcucccccaggaguggguccagcacuucuaccaggaggccgcccccgcccagagcgacguggcgcugcugcgguucgugaacccggacaccggccgcguccucuucgagugcaagcugcacaaguccggguacgugaccguggcccacaccggccagcacgaccuggucaucccgcccaacggguacuuccgguucgacagcugggugaaccaguucuacacccucgcccccaugggcaacggcacggggcgccggcgcuga

SEQ ID NO: 12537 - RNA, 1617 nt, Artificial Sequence
  derived and/or modified sequence opt1 from VP1__Norovirus_and/or_Norovirus-like__KM982942
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgacgacgucuucaccgugagcugccgcgugcugacccggccgucccccgacuucgacuucaucuuccucgucccgcccaccguggagagccgcaccaagcccuucuccgugcccguccugacgguggaggagaugaccaacagccgguuccccaucccccuggagaagcuguucaccggcccguccagcgccuucgucgugcagccccagaacgggcgcugcaccacggacggcgugcuccuggggaccacccagcucucccccgucaacaucugcaccuuccggggcgacgugacgcacaucaccggcagccacaacuacaccaugaaccuggccucccagaacuggagcaacuacgacccgaccgaggagauccccgcgccccuggggacgcccgacuucgugggcaagauccaggggguccucacccagaccacccgcacggacggcagcacccgggggcacaaggccaccguguacaucggcuccgccgacuucgccccgaagcugggccgcgugcaguucgagaccgacacgaaccacgacuucgaggccaaccagaacaccaaguucacccccgucggggugauccaggacggcgggaccacgcaccggaacgagccccagcagugggugcugcccagcuacuccggccgcaacaccccgaacguccaccucgcccccgcgguggcccccaccuuccccggggagcagcugcuguucuuccggagcaccaugccgggcugcuccggcuaccccaacauggaccucgacugccugcugccccaggagugggugcaguacuucuaccaggaggccgcccccgcgcagagcgacgucgcccuccugcgcuucgugaacccggacacggggcgggugcuguucgagugcaagcuccacaaguccggcuacgucaccguggcccacaccgggcagcacgaccuggugaucccgcccaacggcuacuuccgcuucgacagccgggucaaccaguucuacacccuggcccccauggggaacggcaccggccgccgccgguga

SEQ ID NO: 12538 - RNA, 1617 nt, Artificial Sequence
  derived and/or modified sequence opt1 from VP1__Norovirus_and/or_Norovirus-like__KJ685417
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugauccacaucuccggcagccgcaacuacaccaugaaccuggccagccagaacuggaacuccuacgaccccaccgaggagaucccggcgccccuggggacccccgacuucgucggcaagauccagggggugcucacgcagaccacccggaccgacggcagcacgcgcgggcacaaggccaccguguacaccggcuccgccgacuucagccccaagcugggccggguccaguucgccaccgacacggacaacgacuucgugaccaaccagaacaccaaguucaccccggugggggucauccaggacggcuccacgacgccccgcaacgagccccagcagugggugcugcccagcuacuccgggcggaacacccacaacgugcaccucgccccggccgucgcccccaccuuccccggcgagcagcugcuguucuuccgcagcaccaugcccgggugcuccggcuacccgaacauggaccucgacugccugcugccccaggagugggugcaguacuucuaccaggaggcggcccccgcccagagcgacguggcccuccugcgguucgucaaccccgacaccggccgcgugcuguucgagugcaagcuccacaaguccggguacgugaccgucgcgcacaccggccagcacgaccuggugaucccgcccaacggguacuuccgguucgacagcugggugaaccaguucuacacccuggcccccaugggcaacgggacgggccgccgccgguga

SEQ ID NO: 12539 - RNA, 1617 nt, Artificial Sequence
  derived and/or modified sequence opt1 from VP1__Norovirus_and/or_Norovirus-like__KC907392
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccggagccccaucccccuggagaagcuguucacgggcccguccagcgccuucgugguccagccccagaacgggcgcugcaccaccgacggcgugcuccuggggaccacgcagcucucccccgucaacaucugcaccuuccggggcgacguggcccacaucgccggcacccagaacuacaccaugaaccuggccagccagaacuggaacaacuacgacccgacggaggagauccccgcgccccuggggacccccaacuucgugggcaagauccaggggguccucacccagaccacgaagcgcgacggcuccacccgggggcgcaaggccaccgugagcaccggcagcgugcacuucacgccgaagcugggcuccguccaguucagcaccgacaccuccaacgacuucgagaccgggcagaacacgcgguucacccccgugggcgugguccaggacgggagcaccacccaccgcaacgagccccagcagugggugcugcccgacuacuccggccgggacagccacaacgugcaccucgccccggccgucgcccccacguuccccggggagcagcugcuguucuuccgcuccagcaugcccggcugcuccggcuacccgaacauggaccucgacugccugcugccccaggagugggugcagcacuucuaccaggagagcgcgcccgcccaguccgacguggcccuccugcgguucgucaaccccgacaccgggcgcgugcuguucgagugcaagcuccacaagagcggcuacgugaccgucgcccacaccgggcagcacgaccuggugaucccgcccaacggcuacucccgguucgacagcugggugaaccaguucuacacccuggcgcccauggggaacggcgccggccgccgccgguga

SEQ ID NO: 12540 - RNA, 1617 nt, Artificial Sequence
  derived and/or modified sequence opt1 from VP1__Norovirus_and/or_Norovirus-like__KC517377
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacgcgccccugcgggccaacaacgccggcgacgacgucuucaccgugagcugccgcgugcugacgcggccgucccccgacuucgacuucaucuuccucgucccgcccaccguggagagccgcaccaagcccuucuccgugcccguccugaccguggaggagaugacgaacagccgguuccccaucccccuggagaagcuguucaccggcccguccagcgccuucgucgugcagccccagaacgggcgcugcaccaccgacggcgugcuccuggggacgacccagcucucccccgucaacaucugcaccuuccggggcgacgugacccacaucacgggcagccgcaacuacaccaugaaccuggccucccagaacuggaacaacuacgacccgaccgaggagauccccgcgccccuggggacccccgacuucgugggcaagauccaggggguccucacgcagaccacccggaccgacggcagcacgcgcgggcacaaggccaccguguacaccggcagcgccgacuucgccccgaagcugggccgggugcaguucgagaccgacacggaccacgacuucgaggccaaccagaacaccaaguucacccccgucggggugauccaggacggcgggaccacgcaccgcaacgagccccagcagugggugcugcccuccuacagcggccggaacacccacaacguccaccucgcgccggccguggcccccaccuuccccggggagcagcugcuguucuuccgcuccaccaugcccggcugcagcggcuacccgaacauggaccucgacugccugcugccccaggagugggugcaguacuucuaccaggaggccgcgcccgcccaguccgacgucgcccuccugcgguucgugaaccccaacacggggcgcgugcuguucgagugcaagcuccacaagagcggcuacgucaccguggcccacaccgggcagcacgaccuggugaucccgcccaacgacuacuuccgguucgacuccugggucaaccaguucuacacccuggcccccaugggcaacgggaccggccgccgccgguga

SEQ ID NO: 12541 - RNA, 1617 nt, Artificial Sequence
  derived and/or modified sequence opt1 from VP1__Norovirus_and/or_Norovirus-like__KC517368
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucgcccaggcgcccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgagaacgccuucaccgccgggaagaucaucuucgccgccgugccgcccaacuucccgacggagggccugagccccucccgggugaccauguucccccacaucaucguggacguccgccagcuggagcccgugcucaucccgcugcccgacgugcggaacaacuucuaccacuacaaccagagcaacgacuccaccaucaagcugaucgcgaugcucuacacgccccugcgcgccaacaacgccggggaggacgucuucaccgugagcugccgggugcugacccgccccuccccggacuucgacuucaucuuccucgucccgcccaccguggagagccggaccaagcccuucacggugcccauccugaccgucgaggagaccaccaacucccgcuuccccaucccccuggagaagcuguucacgggccccagcuccgccuucguggugcagccgcagaacggccggugcaccaccgacgggguccugcugggcaccacgcagcucagccccgugaacaucugcaccuuccgcggggacgucacccacaucgccggcucccggaacuacaccaugaaccuggcgagccugaacuggaacaacuacgugcccacggaggagaucccggcgccccucggcacccccgacuucguggggaagguccagggcaugcugacccagaccacgaagggggacggcuccacccgcgggcacaaggccaccguguacaccggcagcgcccccuucacgccgaagcugggcagcgugcaguucgagaccgacaccgagaacgacuucgagacccaccagaacacgaaguucacccccgucggggugauccaggacggcgggaccacccaccggaacgagccccagcagugggugcuccccuccuacagcggccgcaacgucccgaacgugcaccuggcccccgccguggcccccacguuccccggggagcagcuccucuucuuccgguccaccaugccgggcugcagcggcuaccccaacauggaccuggacugccugcucccccaggaguggguccagcacuucuaccaggaggccgcccccgcgcaguccgacguggcccugcugcgcuucgugaacccggacaccgggcggguccucuucgagugcaagcugcacaagagcggcuacgugaccguggcccacaccgggcagcacgaccuggucaucccgcccaacggcuacuuccgcuucgacuccugggugaaccaguucuacacgcucgcccccauggggaacggcaccggccggcgccgcuga

SEQ ID NO: 12542 - RNA, 1617 nt, Artificial Sequence
  derived and/or modified sequence opt1 from VP1__Norovirus_and/or_Norovirus-like__AB541310
augaagaugcgcagcuccgacgccaaccccagcgacggcuccaccgccaaccuggugccggaggucaacaacgaggugauggcgcucgagcccguggucggggccgccaucgccgcccccguggcgggccagcagaacgugaucgaccccuggauccggaacaacuucguccaggcccccgggggcgaguucaccgugagcccccgcaacgcccccggggagauccugugguccgcgccccugggcccggaccucaaccccuaccugagccaccuggcccggauguacaacggcuacgccgggggcuucgaggugcaggucauccucgccgggaacgccuucacggccggcaagaucaucuucgcggccgugccgcccaacuucccgaccgaggggcugucccccagccaggugaccauguucccccacaucaucgucgacgugcgccagcuggagcccgugcucaucccgcugcccgacguccggaacaacuucuaccacuacaaccaguccaacgaccccaccaucaagcugaucgccaugcucuacacgccccugcgcgccaacaacgccggcgacgacguguucaccggcagcugccgggugcugacccgcccgucccccgacuucgacuucaucuuccucgucccgcccaccguggagagccggacgaagcccuucuccgugagcuucuucaccggggaggagaugaccaacucccgcuuccccaucccccuggagaagcuguucaccggccccagcuccgcguucgucgugcagccgcagaacgggcggugcacgaccgacggcgugcuccugggcaccacccagcugagccccgucaacaucugcacguuccgcggggacgugacccacaucaccggcucccggaacuacaccaugaaccucgccacgcagaacuggaacagcuacgaccccaccgaggagaucccggcgccccuggggacccccgacuucgucggcaagauccagggggugcugacccagacgacccgcgccgacggcagcacccggggccacaaggccaccguguacacgggguccgccgacuucgcccccaagcucggccgcguccaguucgccaccgacaccgacaacgacuucgacgccaaccagaacaccaaguucacgccggugggggugauccaggacggcgacaccgcccaccggaacgagccccagcaguggguccugcccagcuacuccgggcgcaacagccacaacgugcaccuggcgcccgccguggccccgaccuuccccggcgagcagcuccuguucuuccgguccaccaugcccggcugcagcggguaccccaacauggaccuggacugccuccugccgcaggaguggguccaguacuucuaccaggaggccgcgcccgcccaguccgacguggcccugcuccgcuucgugaaccccgacacgggccggguccuguucgagugcaagcugcacaagagcggguacgugaccguggcccacaccggccagcacgaccucgucaucccgcccaacggguacuuccgcuucgacuccugggugaaccaguucuacacccuggcccccaugggcaacggcaccgggcgccggcgcuga

SEQ ID NO: 12543 - RNA, 1617 nt, Artificial Sequence
  derived and/or modified sequence opt1 from VP1__Norovirus_and/or_Norovirus-like__EF535854
augaagauggccaccaacgacgccagccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgagguggaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucaccguccccauccugaccguggaggagaugacgaacucccgguuccccaucccccuggagaagcuguucaccggccccagcuccgcccucgugguccagccgcagaacgggcgcugcaccaccgacggcgugcugcucgggacgacccagcugagccccgucaacaucugcaccuuccggggcgacgugacccacaucuccggcacgcgcaccuaccggaugaaccuggccagccagaacuggaacaacuacgaccccaccgaggagaucccggcgccccucgggacccccgacuucgugggcaagauccaggggaugcugacgcagaccaccaagggcgacggguccacccgcggccacaaggccacggucagcaccggcagcguggacuucacccccaagcugggguccgugcaguucgccaccgacacggacaacgacuucgagaccggccagaacacccgguucaccccggucggggugauccaggacggcagcuccgcccaccgcaacgagccccagcagugggugcuccccgacuacagcgggcggacgguccacaacgugcaccuggcccccgccguggccccgaccuuccccggcgagcagcugcccuucuuccgcuccaccaugcccggcugcagcggguacccgaacauggaccucgacugccugcugccccaggaguggguccagcacuucuaccaggaggcggcccccucccagagcgacguggcccuccugcgguucgugaaccccgacaccggccgcguccuguucgagugcaagcuccacaaggccggguacgugaccguggcgcacacgggccagcacgaccuggucaucccgcccaacggguacuuccgguucgacuccugggugaaccagagcuacacccuggcccccaugggcaacggcgccgggcgccgccgguga

SEQ ID NO: 12544 - RNA, 1617 nt, Artificial Sequence
  derived and/or modified sequence opt1 from VP1__Norovirus_and/or_Norovirus-like__KX514368
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccaccccggcaacuccaagaucuacacgaugaaccuggccagccccaacuggaacaacuacgacccgaccgaggagauccccgcgccccuggggacccccgacuucgucggcaagauccaggggaugcucacccagacgaccaagggcgaggggagcacccgcggccaccgggccaccguguacgugggcuccgccaacuacgccccgaagcuggggcgcguccaguucgagacggacaccaccgacgaccuggacgcccaccagaacaccaaguucacgcccgugggcgugguccagggcggggagagccccaagggguccgagccccagcagugggugcucccgagcuacuccggccgggacacccccaacgugcaccuggcccccgcggucgcccccaccuucccgggcgagcagcuccucuucuuccgcagcaccauccccgggugcggcgggcaccccaacaugaaccuggacugccugcucccccaggagugggugcagcacuucuaccaggaggccgccccggcgcaguccgacguggcccugcugcgguucgucaaccccgacacgagccgcguccucuucgagugcaagcugcacaaguccggcuacgugaccguggcccacaccgggcagcacgaccuggugaucccgcccaacggcuacuuccgguucgacagcugggugaaccaguucuacacccucgcccccaugggcaacgggacgggccgcaagcgguga

SEQ ID NO: 12545 - RNA, 1617 nt, Artificial Sequence
  derived and/or modified sequence opt1 from VP1__Norovirus_and/or_Norovirus-like__KX514351
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccgggccucaaccccuaccugucccaccuggcccgcauguacaacggguacgccggcggguucgaggugcaggucauccucgccggcaacgccuucacggcggggaagaucaucuucgccgccgugccgcccaacuucccgaccgagggccugaaccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcagcaagcccuucuccguccccgugcugacggugcaggagaugaccaacagccgguuccccgccacccuggacaagcuguucaccgggcccuccagcaaccuggucgugcagccccagaacggccgcugcaugaucgacgggguccugcucggcacgacccagcuguccccggugaacaucugcaccuuccggggcgacgugacccaccuccgcgacagcacgaucuacaccaugaaccucgccucccccaacuggaacaacuacgaccccaccgaggagaucccggcgccccuggggacccccgacuucgucggcaagauccagggggugcugacgcagaccaccaagggcgaggggagcacccggggccaccgcgccacgguguacgucggcagcgccaacuacacccccaagcucgggaaggugcaguucgagaccaacaccacgaacgaccuguacgcccaccagaacaccaaguucaccccggugggcgucgugcagggcggggaguccgcccaccggagcgagccccagcagugggugcugcccggguucuccggccgcgacacccccaacguccaccucgccccggccguggcgcccacguuccccggcgagcagcugcuguucuuccggagcaccauccccgggugcggcgggcacccgaacauggaccucgacugccugcugccccaggagugggugcagcacuucuaccaggaggccgcccccgcccaguccgacgucgcgcuccugcgcuucgugaaccccgacaccagccgggugcuguucgagugcaagcuccacaaguccggcuacgucaccguggcccacacggggcagcacgaccuggugaucccgcccaacggcuacuuccgcuucgacagcugggucaaccaguucuacacccuggcccccaugggcaacgggaccggccggaagcgcuga

SEQ ID NO: 12546 - RNA, 1617 nt, Artificial Sequence
  derived and/or modified sequence opt1 from VP1__Norovirus_and/or_Norovirus-like__KC517372
augaagauggccagcaacgacgccaaccccuccgacggcagcgcggugaaccugguccccgaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucaccgcgggcaagaucaucuucgccgccgugccgcccaacuucccgacggaggggcugagccccucccaggucaccauguucccccacaucaucguggacgcccggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcuccgccuucgugguccagccgcagaacgggcgcugcacgaccgacggcgugcuccuggggaccacccagcucagccccgucaacaucugcacguuccggggcgacguggcccacaucgccggcucccgcaacuacaccaugaaccuggcgagccugaacuggaacaacuacgaccccaccgaggagaucccggcgccccucgggacccccgacuucgugggcaagauccaggggaugcugacgcagaccaccaagggcgacggguccacccggggccacaaggccacggucuacaccggcagcgcccccuucaccccgaagcuggggagcgugcaguucgagaccgacacggagaacgacuucgagacccaccagaacaccaaguucacccccgugggcgucauccaggacgggggcacgacccaccgcaacgagccccagcagugggugcuccccuccuacagcgggcggaacgugccgaacguccaccuggcccccgccguggcccccaccuuccccggcgagcagcugcuccuguuccgcuccaccaugccgggcugcagcggguaccccaacauggaccuggacugccuccugccccaggagugggugcagcacuucuaccaggaggccgcccccgcgcaguccgacgucgcccugcuccgguucgugaacccggacacgggccgcgugcuguucgagugcaagcugcacaagagcggguacgucaccguggcccacaccggccagcacgaccucgugaucccgcccuccggguacuuccgguucgacagcugggucaaccaguucuacacccuggcccccaugggcaacggcaccgggcgccggcgcuga

SEQ ID NO: 12547 - RNA, 1617 nt, Artificial Sequence
  derived and/or modified sequence opt1 from VP1__Norovirus_and/or_Norovirus-like__JN400613
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguuccgcggccggagcuccgcccucgugguccacccccagaacgggcgcugcaccacggacggcgugcugcucgggaccacccagcugagcccggucaacaucugcaccuuccggggcgacgugacgcacaucgccggcucccacaacuacaccaugaaccuggccagccucaacuggaacaacuacgaccccaccgaggagauccccgcgccgcuggggacccccgacuucgugggcaagauccaggggguccugacgcagaccaccaagggcgacggguccacccgcggccacaaggccacgguguacaccggcagcgcccccuucacccccaagcucgggagcgugcaguucuccaccgacacggagaacgacuucgagacccaccagaacaccaaguucaccccggucggcgugauccaggacgggagcacgacccaccggaacgagccccagcagugggugcugcccuccuacagcggcgggaacguccacaacgugcaccuggcccccgccguggcgccgaccuuccccggcgagcagcuccuguucuuccgcuccaccaugcccggcugcagcggguaccccaacauggaccuggacugccuccugccgcaggaguggguccagcacuucuaccaggaggccgcccccgcccaguccgacguggcgcugcuccgguucgugaaccccgacacgggccgcguccuguucgaguacaagcugcacaagagcgacuacgugaccguggcccacaccgggcagcacgaccucgucaucccgcccaacggcuacuuccgguucgacuccugggugaaccaguucuacacccuggccgccauggggaacggcaccggccgccggcgcuga

SEQ ID NO: 12548 - RNA, 1617 nt, Artificial Sequence
  derived and/or modified sequence opt1 from VP1__Norovirus_and/or_Norovirus-like__KX514291
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucaccgggaagauccagggcaugcucacgcagaccaccaagggggagggcagcacccgggggcaccgcgccacggucuacgugggcuccgccaacuacgcccccaagcugggccgggugcaguucgagaccgacaccaccaacgaccuggacgcccaccagaacacgaaguucacccccgucggggugauccagggcggggagagcgcccaccgcuccgagccccagcagugggugcucccgagcuacuccggccgggacacccccaacguccaccuggcgcccgccguggcccccaccuucccgggggagcagcuccucuucuuccgcagcacgauccccggcugcggcgggcaccccaacaugaaccuggacugccugcucccccaggagugggugcagcacuucuaccaggaggccgcgccggcccaguccgacgucgcccugcugcgguucgugaaccccgacaccagccgcguccucuucgagugcaagcugcacaaguccggcuacgugaccguggcccacaccgggcagcacgaccuggugaucccgcccaacggcuacuuccgguucgacagcugggucaaccaguucuacacgcucgcccccauggggaacggcaccggccgcaagcgcuga

SEQ ID NO: 12549 - RNA, 1617 nt, Artificial Sequence
  derived and/or modified sequence opt1 from VP1__Norovirus_and/or_Norovirus-like__KX514219
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagggcggggagagcccccagcgcuccgagccgcagcagugggugcuccccagcuacuccggccgggacacccccaacgugcaccuggcccccgcggucgccccgaccuuccccggggagcagcuccucuucuuccgcagcacccugcccggcugcggcgggcaccccaacauggaccuggacugccuccugccgcaggagugggugcagcacuucuaccaggaggccgcccccgcgcaguccgacguggcccugcuccgguucgucaaccccgacacgagccgcgugcuguucgagugcaagcugcacaaguccggcuacgugaccgucgcccacaccgggcaguacgaccucgugcugcccagcaacggcuacuuccgguucgacuccugggugaaccaguucuacacccuggccccgauggggaacggcacgggccgccgccgguga

SEQ ID NO: 12550 - RNA, 1617 nt, Artificial Sequence
  derived and/or modified sequence opt1 from VP1__Norovirus_and/or_Norovirus-like__AB933668
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccguggugaagacgacccugagcgccgucccgcccaacuucccgaccgagggccugucccccagccaggugaccauguucccccacaucaucguggacguccggcagcucgagcccgugcugaucccgcugcccgacgugcgcaacaacuucuaccacuacaaccaguccaacgacagcacgaucaagcucaucgccaugcuguacacgccccugcgggccaacaacgccggggaggacgucuucaccguguccugccgcgugcucacccggcccagcccggacuucgacuucaucuuccuggucccgcccaccguggagucccgcaccaagcccuucaccgugcccauccugaccgucgaggagaugacgaacagccgguuccccaucccccucgagaagcuguucaccggccccuccagcgcguucgugguccagccgcagaacggccgcugcaccaccgacggggugcugcucggcacgacccagcugucccccgugaacaucugcaccuuccgcggggacgucacccacaucgccggcagccggaacuacacgaugaaccuggccucccucaacuggaacaacuacgaccccaccgaggagaucccggcgccccugggcacccccgacuucguggggaagauccagggcgugcugacccagacgaccaagggggacggcagcacccgggggcacaaggccaccgucuacacgggcagcgcccccuucaccccgaagcucggcuccgugcaguucagcaccgacaccgagaacgacuucgagacgcaccagaacaccaaguucacccccgugggggucauccaggacggcgggaccacgcaccgcaacgagccccagcagugggugcugcccuccuacagcggccggaacgugccgaacguccaccuggcccccgccguggcccccaccuuccccggggagcagcuccuguucuuccgcuccaccaugccgggcugcagcggcuaccccaacauggaccuggacugccuccugccccaggagugggugcagcacuucuaccaggaggccgcgcccgcccaguccgacgucgcccugcuccgguucgugaacccggacaccgggcgcgugcuguucgagugcaagcugcacaagagcggcuacgucaccguggcccacacggggcagcacgaccucgugaucccgcccaacggcuacuuccgguucgacuccugggucaaccaguucuacacccuggcgcccauggggaacggcaccggccgccggcgcuga

SEQ ID NO: 12551 - RNA, 1617 nt, Artificial Sequence
  derived and/or modified sequence opt1 from VP1__Norovirus_and/or_Norovirus-like__KJ678149
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaacgacagcaccaucaagcugaucgccaugcucuacacgccccugcgggcgaacaacgccggcgacgacguguucaccgucuccugccgcgugcugacccggcccagcccggacuucgaccucaucuuccuggugccgcccaccgucgagucccgcaccaagcccuucagcgugcccgugcugacggucgaggagaugaccaacucccgguuccccacgccccucgagaagcuguucaccggccccagcuccgccuucgugguccagccgcagaacgggcgcugcaccaccgacggcgugcugcucgggaccacccagcugagccccgugaacaucugcacguuccggggcgacgucacccacaucaccggcucccgcaacuacaccaugaaccuggccagccagaacuggagcaacuacgaccccacggaggagaucccggcgccccucgggacccccgacuucgugggcaagauccagggggugcugacccagaccacgcggaccgacggcuccacccgcgggcacaaggccaccgucuacacgggcagcgccgacuucgcccccaagcugggccgggugcaguucgagaccgacaccgaccacgacuucgagaccaaccagaacacgaaguucaccccggugggggucauccaggacggcuccaccacccaccgcaacgagccccagcagugggugcuccccagcuacuccgggcggaacacgcccaacgugcaccuggccccggccgucgcgcccaccuuccccggcgagcagcuccuguucuuccgcagcaccauccccgggugcuccggcuacccgaacauggaccuggacugccugcucccccaggagugggugcaguacuucuaccaggaggccgcccccgcccagagcgacguggcgcugcugcgguucgucaaccccgacaccggccgcguccucuucgagugcaagcugcacaaguccggguacgugaccguggcccacacgggccagcacgaccuggugaucccgcccaacggguacuuccgguucgacagcugggugaaccaguucuacacccucgcccccaugggcaacgggaccggccgccgccgguga

SEQ ID NO: 12552 - RNA, 1617 nt, Artificial Sequence
  derived and/or modified sequence opt1 from VP1__Norovirus_and/or_Norovirus-like__KP244318
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggcgacgacguguucaccgugagcugccgcguccugacccggccgucccccgacuucgacuucaucuuccucgugccgcccaccguggagagccgcacgaagcccuucuccguccccgugcugaccguggaggagaugaccaacagccgguuccccaucccccuggagaagcuguucaccggcccguccagcgccuucgucgugcagccccagaacgggcgcugcacgaccgacggcguccuccuggggaccacccagcucucccccgugaacauccggacguuccgcggcgacgugacccacaucccgggcagccggaacuacaccaugaacuccgccagccagaacuggaacagcuacgaccccaccgaggagauccccgcgccccuggggacgccggacuucgucggcaagauccagggggugcugacccagaccacccgcgccaacggcuccacgcgggggcacaaggccaccguguacaccggcagcgccgacuucucccccaagcucggccgcguccaguucgccaccgacacggacaacgacuucgagaccaaccagaacaccaaguucacccccgugggggugauccaggacggcagcacgacgccccggaacgagccgcagcaguggguccugcccuccuacagcgggcgcaacauccacaacgugcaccuggcccccgccguggcgcccaccuucccgggcgagcagcuccuguucuuccgguccaccaugcccgggugcagcggcuaccccaacauggaccuggacugccuccugccccaggaguggguccaguacuucuaccaggaggccgccccggcccaguccgacguggcgcugcuccgcuucgugaaccccgacaccggccggguccuguucgagugcaagcugcacaagagcggguacgugaccguggcccacaccggccagcacgaccucgucaucccgcccaacggguacuuccgcuucgacuccugggugaaccaguucuacacccuggcccccaugggcaacgggaccggccgccggcgcuga

SEQ ID NO: 12553 - RNA, 1617 nt, Artificial Sequence
  derived and/or modified sequence opt1 from VP1__Norovirus_and/or_Norovirus-like__KX514362
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccaccccggcggguccaagaucuacacgaugaaccuggccagccccaacuggaacaacuacgacccgaccgaggagauccccgcgccccugggcacccccgacuucgucgggaagauccagggcaugcucacccagacgaccaagggggagggcagcacccgcggccaccgggccaccguguacgugggguccgccaacuacgccccgaagcugggccgcguccaguucgagacggacaccaccgacgaccuggacgcccaccagaacaccaaguucacgcccgugggggugguccagggcggggagagccccaagggcuccgagccccagcagugggugcucccgagcuacuccggccgggacacccccaacgugcaccuggcccccgcggucgcccccaccuucccgggggagcagcuccucuucuuccgcagcaccauccccggcugcgggggccaccccaacaugaaccuggacugccugcucccccaggagugggugcagcacuucuaccaggaggccgccccggcgcaguccgacguggcccugcugcgguucgucaaccccgacacgagccgcguccucuucgagugcaagcugcacaaguccggguacgugaccguggcccacaccggccagcacgaccuggugaucccgcccaacggcuacuuccgguucgacagcugggugaaccaguucuacacccucgcccccauggggaacggcacggggcgcaagcgguga

SEQ ID NO: 12554 - RNA, 1617 nt, Artificial Sequence
  derived and/or modified sequence opt1 from VP1__Norovirus_and/or_Norovirus-like__KX514329
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcagcaagcccuucuccguccccgugcugaccguggaggagaugacgaacagccgguuccccgccacccuggacaagcuguucaccggccccuccagcaccuucgucgugcagccccagaacgggcgcugcaugaucgacggcguccugcuggggacgacccagcucuccccggugaacaucugcaccuuccggggcgacgugacccacagcggcaacagcaagaucuacacgaugaaccuggccucccccaacuggaacaacuacgaccccaccgaggagaucccggcgccccuggggacccccgacuucgucggcaagauccaggggaugcucacccagacgaccaagggcgaggggagcacccgcggccaccgggccaccguguacgugggcuccgccaacuacgcccccaagcuggggcgcguccaguucgagacggacaccaccgacgaccuggacgcccaccagaacaccaaguucacgccggugggcgugguccagggcggggagagccccaagggguccgagccccagcagugggugcuccccagcuacuccggccgggacaccccgaacgugcaccuggcccccgcggucgcccccaccuuccccggcgagcagcuccucuucuuccgcagcaccaucccggggugcggcgggcaccccaacaugaaccuggacugccugcucccccaggagugggugcagcacuucuaccaggaggccgcccccgcgcaguccgacguggcccugcugcgguucgucaacccggacacgagccgcguccucuucgagugcaagcugcacaaguccggcuacgugaccguggcccacaccgggcagcacgaccuggugaucccgcccaacggcuacuuccgguucgacagcugggugaaccaguucuacacccucgcccccaugggcaacgggacgggccgcaagcgguga

SEQ ID NO: 12555 - RNA, 1617 nt, Artificial Sequence
  derived and/or modified sequence opt1 from VP1__Norovirus_and/or_Norovirus-like__KJ678152
augaagauggccagcuccgacgccaaccccugcgacggcagcgcggccaaccuggugccggaggucaacaacgaggugauggcccucgagcccguggucggggccgccaucgcggcccccgugggcgggcagcagaacgugaucgaccccuggauccgcaacaacuucguccaggccccgggcggggaguucaccgugagcccccggaacgcccccggcgagauccugugguccgcgccccugggcccggaccucaaccccuaccugucccaccuggcccgcauguacaacggguacgccggcggguucgaggugcaggucauccucgccggcaacgccuucaccgcggggaaggugaucuucgccgccgugccgcccaacuuccccacggagggccugagccccucccaggucaccauguucccccacaucgugguggacguccggcagcuggagcccgugcucaucccgcugcccgacgugcgcaacaacuucuaccacuacaaccagagcaacgacuccaccaucaagcugaucgccaugcucuacacgccccugcgggccaacaacgcgggcgacgacgucuucaccgugagcugccgcgugcugacccggcccuccccggacuucgacuucaucuuccucgucccgcccaccguggagagccgcaccaagcccuucuccgugcccguccugacgguggaggagaugaccaacagccgguuccccacgccccuggagaagcuguucaccgggcccuccagcgccuucgucgugcagccgcagaacggccgcugcaccaccgacggggugcuccugggcaccacccagcucucccccgucaacaucugcacguuccggggcgacgugacccacaucaccgggagccgcaacuacaccaugaaccuggccucccagaacuggagcaacuacgaccccacggaggagaucccggcgccccugggcacccccgacuucguggggaagauccagggcguccucacccagaccacgcggaccgacgggagcacccgcggccacaaggccaccguguacaucggcuccgccgacuucgcccccaagcuggggcgggugcaguucgagacggacaccgaccacgacuucgagaccaaccagaacaccaaguucacgccggucggcgugauccaggacgggagcaccacccaccgcaacgagccccagcagugggugcugcccuccuacagcggccggaacacccccaacguccaccucgccccggccguggcccccacguuccccggggagcagcugcuguucuuccgcuccacccuccccggcugcagcggcuacccgaacauggaccuggacugccugcucccccaggagugggugcaguacuucuaccaggaggcggcccccgcccaguccgacgucgcccugcugcgguucgugaaccccgacaccgggcgcguccucuucgagugcaagcugcacaagagcggcuacgugaccguggcgcacaccgggcagcacgaccuggugaucccgcccaacggcuacuuccgguucgacuccugggucaaccaguucuacacgcucgcccccauggggaacggcaccggccgccgccgguga

SEQ ID NO: 12556 - RNA, 1617 nt, Artificial Sequence
  derived and/or modified sequence opt1 from VP1__Norovirus_and/or_Norovirus-like__KX514352
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuguacgcccaccagaacaccaaguucacgcccgugggggugguccagggcggggagagcgcccaccgcuccgagccccagcagugggugcucccgggcuacagcgggcgggacacccccaacgugcaccuggcgcccgccgucgcccccaccuucccgggcgagcagcuccucuucuuccgcuccaccauccccggcugcgggggccaccccaacauggaccuggacugccugcucccccaggagugggugcagcacuucuaccaggaggccgcgccggcccagagcgacguggcccugcugcgguucgucaaccccgacacgucccgcguccucuucgagugcaagcugcacaagagcggguacgugaccguggcccacaccggccagcacgaccuggugaucccgcccaacggguacuuccgguucgacuccugggugaaccaguucuacacccucgcccccaugggcaacggcacggggcgcaagcgcuga

SEQ ID NO: 12557 - RNA, 1617 nt, Artificial Sequence
  derived and/or modified sequence opt1 from VP1__Norovirus_and/or_Norovirus-like__KX514339
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcagcaagcccuucuccguccccgugcugacgguggaggagaugaccaacagccgguuccccgccacccuggacaagcuguucaccggccccuccagcacguucgucgugcagccccagaacgggcgcugcaugaucgacggcguccugcuggggaccacccagcucuccccggugaacaucugcaccuuccggggcgacgugacgcagagcggcaacaccaagaucuacaccaugaaccuggccagccccaacuggaacaacuacgaccccaccgaggagaucccggcgccccuggggacgcccgacuucgucggcaagauccaggggaugcucacccagaccaccaagggcgagggguccacgcgcggccaccgggccaccguguacgugggcagcgccaacuacgcccccaagcuggggcgcguccaguucgagaccgacaccacggacgaccuggacgcccaccagaacaccaaguucaccccggugggcgugguccagggcggggagucccccaaggggagcgagccccagcagugggugcuccccuccuacagcggccgggacaccccgaacgugcaccuggcccccgccgucgcgcccacguuccccggcgagcagcuccucuucuuccgcuccaccaucccggggugcggcgggcaccccaacaugaaccuggacugccugcucccccaggagugggugcagcacuucuaccaggaggccgcccccgcccagagcgacguggcgcugcugcgguucgucaacccggacaccucccgcguccucuucgagugcaagcugcacaagagcggcuacgugaccguggcccacacggggcagcacgaccuggugaucccgcccaacggcuacuuccgguucgacuccugggugaaccaguucuacacccucgcccccaugggcaacgggaccggccgccggcgcuga

SEQ ID NO: 12558 - RNA, 1617 nt, Artificial Sequence
  derived and/or modified sequence opt1 from VP1__Norovirus_and/or_Norovirus-like__KR904238
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcacaaggccaccguguacaccggcuccgccgacuucgcccccaagcugggccgggugcaguucgagacggacaccgaccacgacuucgaggccaaccagaacaccaaguucaccccggucggggugauccaggacggcagcacgacccaccgcaacgagccccagcagugggugcugcccuccuacagcgggcggaacacccacaacguccaccucgcccccgcgguggccccgaccuuccccggcgagcagcugcccuucuuccgcuccacgaugcccgggugcagcggcuacccgaacauggaccuggacugccuccugccccaggagugggugcaguacuucuaccaggaggccgcccccgcgcaguccgacgucgcccugcuccgguucgugaaccccgacaccggccgcgugcuguucgagugcaagcugcacaagagcggguacgucaccguggcccacaccggccagcacgaccucgugaucccgcccuacggguacuuccgguucgacuccugggucaaccaguucuacacccuggcccccaugggcaacgggacgggccgccgccgguga

SEQ ID NO: 12559 - RNA, 1617 nt, Artificial Sequence
  derived and/or modified sequence opt1 from VP1__Norovirus_and/or_Norovirus-like__KJ710245
augaagauggccagcuccgacgccaaccccagcgacggcuccaccgcgaaccuggugccggaggucaacgacgaggugauggcccucgagcccguggucggggccgcccuggccgcgcccguggccggccagcagaacgugaucgaccccuggauccgcaacaacuucguccaggcccccgggggcgaguucaccgugagcccccggaacgcccccggggagauccugugguccgcgccccucggcccggaccugaaccccuaccugagccaccucgcccgcauguacaacggcuacgccgggggcuucgaggugcaggucauccuggccgggaacgccuucacggcgggcaaggugaucuucgccgccgugccgcccaacuucccgaccgaggggcugucccccagccaggucaccauguucccccacaucaucguggacgugcggcagcucgagcccguccugaucccgcugcccgacgcccgcaacaacuucuaccacuacaaccaguccaacgagagcaccaucaagcucaucgccaugcuguacacgccccugcgggcgaacaacgccggcgacgacguguucaccguguccugccgcguccucacccggcccagccuggacuucgacuucaucuuccuggugccgcccaccguggagucccgcacgaagcccuucagcguccccauccucaccguggaggagaugaccaacucccgguucccgaucccccuggagcgccuguucaccggccccagcuccgccuucgccgugcagccccagaacgggcggugcacgaccgacggcguccuccuggggaccacccagcugagcccggugaacaucugcacguuccgcggcgacgucacccacaccaccggcucccacaacuacacgaugaaccucgccagccagaaccggagcaacuacgaccccaccgaggagauccccgcgccgcuggggacccccgacuucgugggcaagauccagggggcccugacccagacgacccgcgccgacggcuccacccgggggcacaaggccaccguguacacgggcagcgccgacuucacccccaagcucggccgcguccaguucgcgaccgacaccgaccacgacuucgacacgaaccagaacaccaaguucacccccgugggggugauccaggacggcuccaccacgcaccggaacgagccgcagcaguggguccugcccagcuacuccgggcgcaacacccacaacgugcaccuggcccccgccguggcccccaccuucccgggcgagcagcuccuguucuuccggagcaccaugcccgggugcuccggcuaccccaacauggaccuggacugccuccugccccaggagugggucgcgcacuucuaccaggaggccgccccggcccagagcgacguggcccugcuccgcuucgugaaccccgacaccggccggguccuguucgagugcaagcugcacaaguccggguacgugacgguggcgcacaccggccagcacgaccucgucaucccgcccaacggguacuuccgcuucgacagcugggugaaccaguucuacacccuggcccccaugggcaacgggaccggccgccggcgcuga

SEQ ID NO: 12560 - RNA, 1617 nt, Artificial Sequence
  derived and/or modified sequence opt1 from VP1__Norovirus_and/or_Norovirus-like__KX514298
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugauccagggcggggagagcgcccaccgcuccgagccccagcaguggguccucccgagcuacuccggccgggacauccccaacgugcaccuggcgcccgccguggcccccaccuucccgggggagcagcuccucuucuuccgcagcaccauccccggcugcggcgggcaccccaacaugaaccuggacugccugcucccccaggaguggguccagcacuucuaccaggaggccgcgccggcccaguccgacguggcccugcugcgguucgugaaccccgacaccagccgcguccucuucgagugcaagcugcacaaguccggcuacgugacgguggcccacaccgggcagcacgaccuggucaucccgcccaacggcuacuuccgguucgacagcugggugaaccaguucuacacccucgcccccauggggaacggcaccggccgcaagcgcuga

SEQ ID NO: 12561 - RNA, 1617 nt, Artificial Sequence
  derived and/or modified sequence opt1 from VP1__Norovirus_and/or_Norovirus-like__KX514269
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucaccgggaagauccagggcaugcucacgcagaccaccaagggggagggcagcacccgggggcaccgcgccacggucuacgugggcuccgccaacuacgcccccaagcugggccgggugcaguucgagaccgacaccaccaacgaccuggacgcccaccagaacacgaaguucacccccgucgggguggugcagagcggcgagucccccaaggggagcgagccgcagcaguggguccuccccuccuacagcggccgcgacacccccaacgugcaccuggcccccgcgguggccccgaccuuccccggggagcagcuccucuucuuccgguccacgauccccggcugcggcgggcaccccaacaugaaccuggacugccugcucccgcaggaguggguccagcacuucuaccaggaggccgcccccgcgcagagcgacguggcccugcugcgcuucgugaaccccgacaccucccggguccucuucgagugcaagcugcacaagagcggcuacgugaccguggcccacaccgggcagcacgaccuggucaucccgcccaacggcuacuuccgcuucgacuccugggugaaccaguucuacacgcucgcccccauggggaacggcaccggccggaagcgcuga

SEQ ID NO: 12562 - RNA, 1617 nt, Artificial Sequence
  derived and/or modified sequence opt1 from VP1__Norovirus_and/or_Norovirus-like__KX514179
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccagaucuacacgaugaaccuggccagccccaacuggaacaacuacgacccgaccgaggagauccccgcgccccugggcacccccgacuucgucgggaagauccagggcaugcucacccagacgaccaagggggagggcagcacccgggggcaccgcgccaccguguacgugggcuccgccaacuacgccccgaagcugggccggguccaguucgagacggacaccaccaacgaccuggacgcccaccagaacaccaaguucacgcccgugggggugguccagggcggggagagccccaagggcuccgagccccagcagugggugcucccgagcuacuccgggcgcgacacccccaacgugcaccuggcccccgcggucgcccccaccuucccgggcgagcagcuccucuucuuccggagcaccauccccggcugcgggggccaccccaacaugaaccuggacugccugcucccccaggagugggugcagcacuucuaccaggaggccgccccggcgcaguccgacguggcccugcugcgcuucgucaaccccgacacgagccggguccucuucgagugcaagcugcacaaguccggguacgugaccguggcccacaccggccagcacgaccuggugaucccgcccaacggguacuuccgcuucgacagcugggugaaccaguucuacacccucgcccccaugggcaacggcacggggcggaagcgcuga

SEQ ID NO: 12563 - RNA, 1617 nt, Artificial Sequence
  derived and/or modified sequence opt1 from VP1__Norovirus_and/or_Norovirus-like__KX514289
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagagcggcgagucccccaaggggagcgagccgcagcagugggugcuccccuccuacagcggccgcgacacccccaacgugcaccuggcccccgcggucgccccgaccuuccccggggagcagcuccucuucuuccgguccaccauccccggcugcggcgggcaccccaacaugaaccuggacugccugcucccgcaggagugggugcagcacuucuaccaggaggccgcccccgcgcagagcgacguggcccugcugcgcuucgucaaccccgacacgucccggguccucuucgagugcaagcugcacaagagcggcuacgugaccguggcccacaccgggcagcacgaccuggugaucccgcccaacggcuacuuccgcuucgacuccugggugaaccaguucuacacccucgcccccauggggaacggcacgggccggaagcgcuga

SEQ ID NO: 12564 - RNA, 1617 nt, Artificial Sequence
  derived and/or modified sequence opt1 from VP1__Norovirus_and/or_Norovirus-like__KX514288
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagagcggcgagucccccaaggggagcgagccgcagcagugggugcuccccuccuacagcggccgcgacacccccaacgugcaccuggcccccgcggucgccccgaccuuccccggggagcagcuccucuucuuccgguccaccauccccggcugcggcgggcaccccaacauggaccuggacugccugcucccgcaggagugggugcagcacuucuaccaggaggccgcccccgcgcagagcgacguggcccugcugcgcuucgucaaccccgacacgucccggguccucuucgagugcaagcugcacaagagcggcuacgugaccguggcccacaccgggcagcacgaccuggugaucccgcccaacggcuacuuccgcuucgacuccugggugaaccaguucuacacccucgcccccauggggaacggcacgggccggaagcgcuga

SEQ ID NO: 12565 - RNA, 1617 nt, Artificial Sequence
  derived and/or modified sequence opt1 from VP1__Norovirus_and/or_Norovirus-like__KX514268
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccacggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagggcggggagagccccaagggcuccgagccgcagcagugggugcuccccagcuacuccgggcgcgacacccccaacgugcaccuggcccccgcggucgccccgaccuuccccggcgagcagcuccucuucuuccggagcaccauccccggcugcgggggccaccccaacaugaaccuggacugccugcucccgcaggagugggugcagcacuucuaccaggaggccgcccccgcgcaguccgacguggcccugcugcgcuucgucaaccccgacacgagccggguccucuucgagugcaagcugcacaaguccggguacgugaccguggcccacaccggccagcacgaccuggugaucccgcccaacggguacuuccgcuucgacagcugggugaaccaguucuacacccucgcccccaugggcaacggcacggggcggaagcgcuga

SEQ ID NO: 12566 - RNA, 1617 nt, Artificial Sequence
  derived and/or modified sequence opt1 from VP1__Norovirus_and/or_Norovirus-like__JX459653
augaagauggccagcuccgaccccaacccgagcgacggcuccaccgccaaccuggugcccgaggucaacaacgaggugauggcgcucgagcccguggucggggccgccaucgccgcccccguggcgggccagcagaacgugaucgacccguggauccgcaacaacuucguccaggcccccgggggcgaguucaccgugagcccccggaacgcccccggggagauccugugguccgccccgcugggccccgaccucaaccccuaccugagccaccuggcgcgcauguacaacggcuacgccgggggcuucgaggugcaggucauccucgccgggaacgccuucacggccggcaagaucaucuucgcggccgugcccccgaacuuccccaccgaggggcugucccccagccaggugaccauguucccccacaucaucgucgacgugcggcagcuggagccggugcucaucccccugcccgacguccgcaacaacuucuaccacuacaaccaguccaacgacagcaagcugaagcuccggcccaugcuguacaccccgcugcgcgccaacaacgccggcgacgacguguucacgguguccugccggguccucacccgccccagccccgacuucgacuucaucuuccuggugcccccgaccguggagucccggaccaagcccuucagcguccccgugcugacgguggaggagaugaccaacucccgcuuccccaucccgcucgagaagcuguucaccggccccagcuccgccuucgucgugcagccccagaacgggcggugcaccacggacggcguccugcucgggaccacccagcugagcccggugaacaucugcaccuuccgcggcgacgugacgcacauccccggcucccggaacuacaccaugaaccuggcgagccagaacuggaacagcuacgaccccaccgaggagauccccgccccgcucgggacccccgacuucgucggcaagauccagggggugcugacgcagaccacccgcaccaacggcuccacgcgggggcacaaggccaccguguacaccggcagcgccgacuucucccccaagcugggccgcguccaguucgccaccgacacggacaacgacuucgagaccaaccagaacaccaaguucacccccgugggggugauccaggacggcagcacgaccccgcggaacgagccccagcaguggguccuccccuccuacagcgggcgcaacauccacaacgugcaccuggcgcccgccguggccccgaccuuccccggcgagcagcuccuguucuuccgguccaccaugcccgggugcagcggcuaccccaacauggaccuggacugccugcucccgcaggaguggguccaguacuucuaccaggaggccgcccccgcgcaguccgacguggcccugcugcgcuucgugaaccccgacacgggccggguccucuucgagugcaagcugcacaagagcggguacgugaccguggcccacaccggccagcacgaccuggucaucccgcccaacggguacuuccgcuucgacuccugggugaaccaguucuacacccucgcccccaugggcaacgggaccggccgccggcgcuga

SEQ ID NO: 12567 - RNA, 1617 nt, Artificial Sequence
  derived and/or modified sequence opt1 from VP1__Norovirus_and/or_Norovirus-like__KX514359
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagggcggggagagcccccagcgcuccgagccgcagcagugggugcuccccagcuacuccggccgggacacccccaacgugcaccuggcccccgcggucgccccgaccuuccccggggagcagcuccucuucuuccgcagcaccauccccggcugcggcgggcaccccaacaugaaccuggacugccugcucccgcaggagugggugcagcacuucuaccaggaggccgcccccgcgcaguccgacguggcccugcugcgguucgucaaccccgacacgagccgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgcaagcgcuga

SEQ ID NO: 12568 - RNA, 1617 nt, Artificial Sequence
  derived and/or modified sequence opt1 from VP1__Norovirus_and/or_Norovirus-like__KX514296
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggggaccaccaacgaccuggacgcccaccagaacaccaaguucacgcccgugggcgugguccagggcggggagagcccccagggguccgagccgcagcagugggugcuccccagcuacuccggccgcgacacccccaacgugcaccuggcccccgcggucgccccgaccuuccccggcgagcagcuccucuucuuccggagcaccauccccgggugcggcgggcaccccaacaugaaccuggacugccugcucccgcaggagugggugcagcacuucuaccaggaggccgcccccgcgcaguccgacguggcccugcugcgcuucgucaaccccgacacgagccggguccucuucgagugcaagcugcacaaguccggcuacgugaccguggcccacaccgggcagcacgaccuggugaucccgcccaacggcuacuuccgcuucgacagcugggugaaccaguucuacacccucgcccccaugggcaacgggacgggccggaagcgcuga

SEQ ID NO: 12569 - RNA, 1617 nt, Artificial Sequence
  derived and/or modified sequence opt1 from VP1__Norovirus_and/or_Norovirus-like__KX514284
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagggcggggagagcccccagcgcuccgagccgcagcagugggugcuccccagcuacuccggccgggacacccccaacgugcaccuggcccccgcggucgccccgaccuuccccggggagcagcuccucuucuuccgcagcaccauccccggcugcggcgggcaccccaacauggaccuggacugccugcucccgcaggagugggugcagcacuucuaccaggaggccgcccccgcgcaguccgacguggcccugcugcgguucgucaaccccgacacgagccgcguccucuucgagugcaagcugcacaaguccggcuacgugaccguggcccacaccgggcagcacgaccuggugaucccgcccaacggcuacuuccgguucgacagcugggugaaccaguucuacacccucgcccccauggggaacggcacgggccgcaagcgcuga

SEQ ID NO: 12570 - RNA, 1617 nt, Artificial Sequence
  derived and/or modified sequence opt1 from VP1__Norovirus_and/or_Norovirus-like__KX514245
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagggcggggagagcccccagcgcuccgagccgcagcagugggugcuccccagcuacuccggccgggacacccccaacgugcaccuggcccccgcggucgccccgaccuuccccggggagcagcuccucuucuuccgcagcaccauccccggcugcggcgggcaccccaacaugaaccuggacugccugcucccgcaggagugggugcagcacuucuaccaggaggccgcccccgcgcaguccgacguggcccugcugcgguucgucaaccccgacacgagccgcguccucuucgagugcaagcugcacaaguccggcuacgugaccgugacccacaccgggcagcacgaccuggugaucccgcccaacggcuacuuccgguucgacagcugggugaaccaguucuacacgcucgcccccauggggaacggcaccggccgcaagcgcuga

SEQ ID NO: 12571 - RNA, 1617 nt, Artificial Sequence
  derived and/or modified sequence opt1 from VP1__Norovirus_and/or_Norovirus-like__KX514327
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcagcaagcccuucuccguccccgugcugaccguggaggagaugaccaacagccgguuccccgccacccuggacaagcuguucacgggccccuccagcaccuucgucgugcagccccagaacgggcgcugcaugaucgacggcguccugcuggggaccacccagcucuccccggugaacaucugcacguuccggggcgacgugacccacagcggcaacagcaagaucuacaccaugaaccuggccucccccaacuggaacaacuacgaccccaccgaggagaucccggcgccccuggggacgcccgacuucgucggcaagauccaggggaugcucacccagaccaccaagggcgaggggagcacgcgcggccaccgggccaccguguacgugggcuccgccaacuacgcccccaagcuggggcgcguccaguucgagaccgacaccacggacgaccuggacgcccaccagaacaccaaguucaccccggugggcgugguccagggcggggagagccccaagggguccgagccccagcagugggugcuccccagcuacuccggccgggacaccccgaacgugcaccuggcccccgccgucgcgcccacguuccccggcgagcagcuccucuucuuccgcagcaccaucccggggugcggcgggcaccccaacaugaaccuggacugccugcucccccaggagugggugcagcacuucuaccaggaggccgcccccgcccaguccgacguggcgcugcugcgguucgucaacccggacaccagccgcguccucuucgagugcaagcugcacaaguccggcuacgugaccguggcccacacggggcagcacgaccuggugaucccgcccaacggcuacuuccgguucgacagcugggugaaccaguucuacacccucgcccccaugggcaacgggaccggccgcaagcgguga

SEQ ID NO: 12572 - RNA, 1617 nt, Artificial Sequence
  derived and/or modified sequence opt1 from VP1__Norovirus_and/or_Norovirus-like__KX514301
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagggcggggagagccccaagggcuccgagccgcagcagugggugcuccccagcuacuccgggcgcgacacccccaacgugcaccuggcccccgcggucgccccgaccuuccccggcgagcagcuccucuucuuccggagcaccauccccggcugcgggggccaccccaacaugaaccuggacugccugcucccgcaggagugggugcagcacuucuaccaggaggccgcccccgcgcaguccgacguggcccugcugcgcuucgucaaccccgacacgagccggguccucuucgagugcaagcugcacaaguccggguacgugaccguggcccacaccggccagcacgaccuggugaucccgcccaacggguacuuccgcuucgacagcugggugaaccaguucuacacccucgcccccaugggcaacggcacggggcggaagcgcuga

SEQ ID NO: 12573 - RNA, 1617 nt, Artificial Sequence
  derived and/or modified sequence opt1 from VP1__Norovirus_and/or_Norovirus-like__KX514299
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagggcggggagagcccccagggcuccgagccgcagcagugggugcuccccagcuacuccgggcgcgacacccccaacgugcaccuggcccccgcggucgccccgaccuuccccggcgagcagcuccucuucuuccggagcaccauccccggcugcgggggccaccccaacaugaaccuggacugccugcucccgcaggagugggugcagcacuucuaccaggaggccgcccccgcgcaguccgacguggcccugcugcgcuucgucaaccccgacacgagccggguccucuucgagugcaagcugcacaaguccggguacgugaccguggcccacaccggccagcacgaccuggugaucccgcccaacggguacuuccgcuucgacagcugggugaaccaguucuacacccucgcccccaugggcaacggcacggggcggaagcgcuga

SEQ ID NO: 12574 - RNA, 1617 nt, Artificial Sequence
  derived and/or modified sequence opt1 from VP1__Norovirus_and/or_Norovirus-like__KX514277
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggagcucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccagggcaugcucacccagacgaccaagggggagggcagcacccgggggcaccgcgccaccguguacgugggcuccgccaacuacgcccccaagcugggccggguccaguucgagacggacaccaccaacgaccuggacgcccaccagaacaccaaguucacgcccgugggggugguccagggcggggagagccccaagggcuccgagccgcagcagugggugcuccccagcuacuccgggcgcgacacccccaacgugcaccuggcccccgcggucgccccgaccuuccccggcgagcagcuccucuucuuccggagcaccauccccggcugcgggggccaccccaacaugaaccuggacugccugcucccgcaggagugggugcagcacuucuaccaggaggccgcccccgcgcaguccgacguggcccugcugcgcuucgucaaccccgacacgagccggguccucuucgagugcaagcugcacaaguccggguacgugaccguggcccacaccggccagcacgaccuggugaucccgcccaacggguacuuccgcuucgacagcugggugaaccaguucuacacccucgcccccaugggcaacggcacggggcggaagcgcuga

SEQ ID NO: 12575 - RNA, 1617 nt, Artificial Sequence
  derived and/or modified sequence opt1 from VP1__Norovirus_and/or_Norovirus-like__KX514213
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccgugcaggagaugacgaacucccgguuccccgccacccuggacaagcuguucaccggccccagcuccaaccucgucgugcagccccagaacgggcgcugcaugaucgacggcguccugcucgggaccacgcagcugagcccggugaacaucugcaccuuccggggcgacgugacccacccccgcgacucccccaucuacaccaugaaccuggccagcccgaacuggaacaacuacgaccccacggaggagauccccgcgccccucggcaccccggacuucgucgggaagauccagggcaugcugacccagaccacgaagggggagggcagcacccgggggcaccgcgccaccguguacgugggcuccgccaacuacgcccccaagcugggccggguccaguucgagaccgacacgaccaacgaccucgacgcccaccagaacaccaaguucacccccgugggggugguccagggcggggagagcccccagcgcuccgagccgcagcagugggugcugcccagcuacuccggccgggacacgcccaacgugcaccuggcccccgcggucgccccgaccuuccccggggagcagcuccuguucuuccgcagcaccauccccggcugcggcgggcaccccaacaugaaccuggacugccuccugccgcaggagugggugcagcacuucuaccaggaggccgcccccgcgcaguccgacguggcccugcuccgguucgucaaccccgacaccagccgcgugcuguucgagugcaagcugcacaaguccggcuacgugacggucgcccacaccgggcagcacgaccucgugaucccgcccaacggcuacuuccgguucgacagcugggugaaccaguucuacacccuggcccccauggggaacggcaccggccgcaagcgcuga

SEQ ID NO: 12576 - RNA, 1617 nt, Artificial Sequence
  derived and/or modified sequence opt1 from VP1__Norovirus_and/or_Norovirus-like__KT033903
augaagauggccagcuccgacgccaaccccagcgacggcuccaccgcgaaccuggugcccgaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcggcgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccgggcccagcuccgccuucgucgugcagccgcagaacggccgcugcacgaccgacgggguccuccugggcaccacccagcucagccccgugaacaucugcacguuccggggcgacgugacccacauccccgggucccgcaacuacaccaugaaccuggccagccagaacuggaacagcuacgacccgaccgaggagauccccgcgccccugggcacgcccgacuucgucgggaaggugcagggcgugcucacccagaccacccggacgaacggguccacccgcggccacaaggccaccgucuacaccggcagcgccgacuucuccccgaagcuggggcgggugcaguucgccacggacaccgacaacgacuucgagaccaaccagaacaccaaguucacgcccgugggcgucauccaggacgggagcaccacgccccgcaacgagccccagcagugggugcugccguccuacagcggccggaacauccacaacgugcaccucgcccccgccgucgcccccaccuuccccggggagcagcugcuguucuuccgcuccaccaugccgggcugcagcggcuaccccaacauggaccucgacugccugcugccccaggagugggugcaguacuucuaccaggaggcggcccccgcccaguccgacguggcccuccugcgguucgucaacccggacaccgugcgcgugcuguucgagugcaagcuccacaagagcggguacgucaccguggcgcacaccggccagcacgaccuggugaucccgcccaacggguacuuccgguucgacuccugggucaaccaguucuacacccuggcccccaugggcaacgggacgggccgccgccgguga

SEQ ID NO: 12577 - RNA, 1617 nt, Artificial Sequence
  derived and/or modified sequence opt1 from VP1__Norovirus_and/or_Norovirus-like__HM625866
augaagauggccagcuccgacgccaaccccagcgacggcuccaccgcgaaccuggugcccgaggucaacaacgaggugauggcccucgagcccguggucggggccgccagcgccgcgcccguggccggccagcagaacgugaucgaccccuggauccgcaacaacuucguccaggcccccgggggcgaguucaccgagucccccacgaacgcccccggggagauccuguggagcgcgccccugggcccggaccucaaccccuaccugucccaccuggcccggauguacaacggcuacgccgggggcuucgagguccaggugauccucgccgggaacgccuucaccgcgggcaagaucaucuucgccgccgugccgcccaacuucccgaccgaggggcugagccccucccaggugaccauguucccccacaucaucguggacguccgccagcuggagcccgugcucaucccgcugcccgacgugcggaacaacuucuaccacuacaaccagagcaacgaccccacgaucaagcugaucgccaugcucuacacgccccugcgcgccaacaacgcgggcgacgacgucuucaccguguccugccgggugcugacccgcccgagccccgacuucgacuucaucuuccucguccccgccaccguggagucccggaccaagcccuucagcgugccgguccugaccguggaggagaugaccaacucccgcuuccccaucccccuggagaagcuguucacgggccccagcuccgccuucgugguccagccgcagaacgggcggugcaccaccgacggcgugcuccuggggaccacgcagcucagccccgucaacaucugcaccuuccgcggcgacgugacccacauccccggcucccggaacuacaccaugaaccuggccagccagaacuggaacagcuacgacccgacggaggagauccccgcccccguggggacccccgacuucgucggcaagauccagggggugcugacccagaccacgcgcaccaacggcuccacccgggggcacaaggcgaccguguacacgggcagcgccgacuucuccccgaagcucggccgcguccaguucgccaccgacaccgacaacgacuucgagaccaaccagaacacgaaguucacccccgugggggugauccaggacggcagcaccacgccccggaacgagccccagcaguggguccugccguccuacagcgggcgcaacauccacaacgugcaccuggcccccgccguggcgcccaccuuccccggcgagcagcuccuguucuuccgguccaccaugccggggugcagcggcuaccccaacauggaccuggacugccuccugccccaggaguggguccaguacuucuaccaggaggccgcccccgcccaguccgacguggcgcugcuccgcuucgugaacccggacaccggccggguccuguucgagugcaagcugcacaagagcggguacgugaccguggcccacaccggccagcacgaccucgucaucccgcccaacggguacuuccgcuucgacuccugggugaaccaguucuacacgcuggcccccaugggcaacgggaccggccggcgccgcuga

SEQ ID NO: 12578 - RNA, 1617 nt, Artificial Sequence
  derived and/or modified sequence opt1 from VP1__Norovirus_and/or_Norovirus-like__KX514319
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcagcaagcccuucuccguccccgugcugaccguggaggagaugaccaacagccgguuccccgccacccuggacaagcuguucacgggccccuccagcaccuucgucgugcagccccagaacgggcgcugcaugaucgacggcguccugcuggggaccacccagcucuccccggugaacaucugcacguuccggggcgacgugacccaccccggcgggagcaagaucuacaccaugaaccuggccagccccaacuggaacaacuacgacccgaccgaggagauccccgcgccccugggcacgcccgacuucgucgggaagauccagggcaugcucacccagaccaccaagggggagggcuccacgcgcggccaccgggccaccguguacguggggagcgccaacuacgccccgaagcugggccgcguccaguucgagaccgacaccacggacgaccuggacgcccaccagaacaccaaguucacccccgugggggugguccagggcggggagucccccaagggcagcgagccccagcagugggugcucccguccuacagcggccgggacacccccaacgugcaccuggcccccgccgucgcgcccacguucccgggggagcagcuccucuucuuccgcuccaccauccccggcugcgggggccaccccaacauggaccuggacugccugcucccccaggagugggugcagcacuucuaccaggaggccgccccggcccagagcgacguggcgcugcugcgguucgucaaccccgacaccucccgcguccucuucgagugcaagcugcacaagagcggguacgugaccguggcccacacgggccagcacgaccuggugaucccgcccaacggcuacuuccgguucgacuccugggugaaccaguucuacacccucgcccccauggggaacggcaccgggcgccggcgcuga

SEQ ID NO: 12579 - RNA, 1617 nt, Artificial Sequence
  derived and/or modified sequence opt1 from VP1__Norovirus_and/or_Norovirus-like__KX514311
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgcgaacgugguccagccgcagaacggccggugcaugaucgacggggugcugcugggcacgacccagcucagccccgucaacaucugcaccuuccgcggcgacgugacccaccccgggggcuccaagaucuacacgaugaaccuggccagcccgaacuggaacaacuacgaccccaccgaggagauccccgcgccccuggggaccccggacuucgugggcaagauccaggggaugcucacccagacgaccaagggcgagggcagcacccgggggcaccgcgccaccgucuacgugggcuccgccaacuacgcccccaagcuggggcgggugcaguucgagacggacaccaccgacgaccuggacgcccaccagaacaccaaguucacgcccgucggcguggugcagggcggggagagccccaagggcuccgagccgcagcaguggguccuccccagcuacuccgggcgcgacacccccaacgugcaccuggcccccgccguggccccgaccuuccccggcgagcagcuccuguucuuccggagcaccauccccgggugcggcgggcaccccaacaugaaccuggacugccugcucccgcaggaguggguccagcacuucuaccaggaggcggcccccgcccaguccgacguggcccugcugcgcuucgugaaccccgacacgagccggguccucuucgagugcaagcugcacaaguccggcuacgugaccguggcgcacaccggccagcacgaccuggucaucccgcccaacggguacuuccgcuucgacagcugggugaaccaguucuacacccucgcccccaugggcaacgggacgggccggaagcgcuga

SEQ ID NO: 12580 - RNA, 1617 nt, Artificial Sequence
  derived and/or modified sequence opt1 from VP1__Norovirus_and/or_Norovirus-like__KX514266
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccaccccggcgacucccccaucuacacgaugaaccuggccagcccgaacuggaacaacuacgaccccaccgaggagauccccgcgccccuggggaccccggacuucgucggcaagauccaggggaugcucacccagacgaccaagggcgaggggagcacccgcggccaccgggccaccguguacgugggcuccgccaacuacgcccccaagcuggggcgcguccaguucgagacggacaccaccaacgaccuggacgcccaccagaacaccaaguucacgcccgugggcgugguccagggcggggagagccccaagggguccgagccgcagcagugggugcuccccagcuacuccggccgggacacccccaacgugcaccuggcccccgcggucgccccgaccuuccccggcgagcagcuccucuucuuccgcagcaccauccccgggugcggcgggcaccccaacaugaaccuggacugccugcucccgcaggagugggugcagcacuucuaccaggaggccgcccccgcgcaguccgacguggcccugcugcgguucgucaaccccgacacgagccgcguccucuucgagugcaagcugcacaaguccggcuacgugaccguggcccacaccgggcagcacgaccuggugaucccgcccaacggcuacuuccgguucgacagcugggugaaccaguucuacacccucgcccccaugggcaacgggacgggccgcaagcgguga

SEQ ID NO: 12581 - RNA, 1617 nt, Artificial Sequence
  derived and/or modified sequence opt1 from VP1__Norovirus_and/or_Norovirus-like__KX514235
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcuccgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcagcaagcccuucuccguccccgugcugaccguggaggagaugacgaacagccgguuccccgccacccuggacaagcuguucaccggccccuccagcaccuucgucgugcagccccagaacgggcgcugcaugaucgacggcguccugcuggggacgacccagcucuccccggugaacaucugcaccuuccggggcgacgugacccacccccgcgacagccccaucuacacgaugaaccuggccagcccgaacuggaacaacuacgaccccaccgaggagauccccgcgccccugggcaccccggacuucgucgggaagauccagggcaugcucacccagacgaccaagggggagggcuccacccgggggcaccgcgccaccguguacgugggcagcgccaacuacgcccccaagcugggccggguccaguucgagacggacaccaccaacgaccuggacgcccaccagaacaccaaguucacgcccgugggggugguccagggcggggagagcccccagcgcuccgagccgcagcagugggugcuccccuccuacagcggccgggacacccccaacgugcaccuggcccccgcggucgccccgaccuuccccggggagcagcuccucuucuuccgcuccaccauccccggcugcggcgggcaccccaacaugaaccuggacugccugcucccgcaggagugggugcagcacuucuaccaggaggccgcccccgcgcagagcgacguggcccugcugcgguucgucaaccccgacacgucccgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcacgggccgcaagcgcuga

SEQ ID NO: 12582 - RNA, 1617 nt, Artificial Sequence
  derived and/or modified sequence opt1 from VP1__Norovirus_and/or_Norovirus-like__KX354115
augaagauggccagcuccgacgccaaccccagcgacggcuccgcggccaaccuggugccggaggccaacaacgaggucauggcccucgagcccguggccggggcggcccuggccgcccccguggcgggccagcagaacgucaucgaccccuggauccgcaacaacuucgugcaggcccccgggggcgaguucaccaucagcccccggaacgcccccggggagauccugugguccgcgccccucggcccggaccugaaccccuaccugagccaccucgcccgcauguacaacggcuacgccgggggcuucgaggugcaggucauccuggccgggaacgccuucaccgccggcaaggugaucuucgccgcggugccgcccaacuucccgacguccgggcugagccccucccaggucaccauguuccccagcgugguggucgacgugcggcagcucgagcccgugcugaucccgcugcccgacguccgcaacaacuucuaccacuacaaccaguccaacgaccccaccaucacccucaucgccaugcuguacacgccccugcgggccaacaacgccggcgacgacguguucaccgugagcugccgcguccucacccggccgucccccgacuucgacuucaucuuccuggugccgcccaccguggagagccgcacgaagcccuucuccguccccgugcugaccguggaggagaugaccaacagccgguuccccaucccccucgagcgccuguucaccggcccguccagcgccuucgucgugcagccccagaacgggcggugcacgaccgacggcguccugcucgggaccacccagcugucccccgugaacaucugcacguuccgcggcgacaucauccacaucaccggcagccacaacuacaccaugaaccuggcgagccagaacuggaacaacuacgacccgaccgaggagauccccgcgccccucgggacgcccgacuucgugggcaagauccaggggguccugacccagaccacccggggcgacggguccacgcgcggccacaaggccaccguguacaccggcagcgccgacuucaucccgaagcuggggcgggugcaguucgagaccgacacgaaccacgacuucgaggccaaccagaacaccaaguucacccccgucggcgugauccaggacggguccaccacgcaccgcaacgagccccagcagugggugcuccccagcuacuccggccggaacacccacaacguccaccuggccccggccguggcccccaccuuccccggggagcagcuccucuucuuccgcagcaccaugcccggcugcuccggcuacccgaacauggaccuggacugccugcucccccaggagugggugcaguacuucuaccaggaggccgcgcccgcccagagcgacgucgcccugcugcgguucgugaaccccgacacggggcgcgugcuguucgagugcaagcugcacaaguccggcuacaucaccgucgcccacaccgggcagcacgaccuggugaucccgcccaacggcuacuuccgguucgacagcugggugaaccaguucuacacccucgcccccauggggaacggcaccggccgccgccgguga

SEQ ID NO: 12583 - RNA, 1617 nt, Artificial Sequence
  derived and/or modified sequence opt1 from VP1__Norovirus_and/or_Norovirus-like__KM272334
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcaccuacaacggcuacgccgggggcuucgaggugcaggucauccucgccgggaacgccuucacggccggcaaggugaucuucgccgccgugccgcccaacuucccgaccgaggggcugucccccagccaggucaccauguucccccacaucgugguggacgcccggcagcuggagcccguccucaucccgcugcccgacgugcgcaacaacuucuaccacuacaaccaguccaacgaccccaccaucaagcugaucgcgaugcucuacacgccccugcgggccaacaacgccggcgacgacguguucaccgucagcugccgcgugcugacccggccgucccccgacuucgacuucaucuuccucgugccgcccaccgucgagagccgcacgaagcccuucuccgugcccgugcugaccgucgaggagaugaccaacagccgguuccccaucccccuggagaagcuguucaccggcccguccagcgccuucgugguccagccccagaacucccgcugcacgaccgacggggugcuccugggcaccacccagcucagccccgugaacaucugcacguuccgcggggacgucacccacaucaccggcucccggaacuacaccaugaaccuggccagccagaacuggaacaacuacgacccgacggaggagauccccgugccccugggcacccccgacuucguggggaagauccagggcguccucacccagaccacgcggaccgacgggagcacccgcggccacaaggcgaccguguacacgggguccgccgacuucgccccgaagcugggccgggugcaguucgagaccgacaccgaccacgacuucgaggccaaccagaacaccaaguucacgcccgucggcgugauccaggacgggggcaccacccaccgcaacgagccccagcagugggugcugcccagcuacuccgggcggaacacccacaacguccaccucgccccggcgguggcccccacguuccccggcgagcagcugcuguucuuccgcagcaccaugcccgggugcuccggcuacccgaacauggaccucgacugccugcugccccaggagugggugcaguacuucuaccagggcgccgcccccgcgcagagcgacgucgcccuccugcgguucgugaaccccgacaccgggcgcgugcuguucgagugcaagcuccacaaguccggcuacgucaccguggcccacaccgggcagcacgaccuggugaucccgcccaacggcuacuuccgguucgacagcugggucaaccaguucuacacgcuggcccccauggggaacggcaccggccgccgccgguga

SEQ ID NO: 12584 - RNA, 1617 nt, Artificial Sequence
  derived and/or modified sequence opt1 from VP1__Norovirus_and/or_Norovirus-like__KX354116
augaagauggccagcuccgacgccaaccccagcgacggcuccgcggccaaccuggugccggaggccaacaacgaggucauggcccucgagcccguggccggggcggcccuggccgcccccguggcgggccagcagaacgucaucgaccccuggauccgcaacaacuucgugcaggcccccgggggcgaguucaccaucagcccccggaacgcccccggggagauccugugguccgcgccccucggcccggaccugaaccccuaccugagccaccucgcccgcauguacaacggcuacgccgggggcuucgaggugcaggucauccuggccgggaacgccuucaccgccggcaaggugaucuucgccgcggugccgcccaacuucccgacggccgggcugucccccagccaggucaccauguuccccuccgugguggucgacgugcggcagcucgagcccgugcugaucccgcugcccgacguccgcaacaacuucuaccacuacaaccagagcaacgaccccaccaucacccucaucgccaugcuguacacgccccugcgggccaacaacgccggcgacgacguguucaccguguccugccgcguccucacccggccgagccccgacuucgacuucaucuuccuggugccgcccaccguggagucccgcacgaagcccuucagcguccccgugcugaccguggaggagaugaccaacucccgguuccccaucccccucgagcgccuguucaccggcccgagcuccgcguucgucgugcagccccagaacgggcggugcacgaccgacggcguccugcucgggaccacccagcugagccccgugaacaucugcacguuccgcggcgacaucauccacaucaccggcucccacaacuacaccaugaaccuggccagccagaacuggaacaacuacgacccgaccgaggagauccccgcgccccucgggacgcccgacuucgugggcaagauccaggggguccugacccagaccacccggggcgacgggagcacgcgcggccacaaggccaccguguacaccggcuccgccgacuucaucccgaagcuggggcgggugcaguucgagaccgacacgaaccacgacuucgaggccaaccagaacaccaaguucacccccgucggcgugauccaggacgggagcaccacgcaccgcaacgagccccagcagugggugcuccccuccuacagcggccggaacacccacaacguccaccuggccccggccguggcccccaccuuccccggggagcagcuccucuucuuccgcuccaccaugcccggcugcagcggcuacccgaacauggaccuggacugccugcucccccaggagugggugcaguacuucuaccaggaggcggcccccgcccaguccgacgucgcccugcugcgguucgugaaccccgacacggggcgcgugcuguucgagugcaagcugcacaagagcggcuacaucaccgucgcccacaccgggcagcacgaccuggugaucccgcccaacggcuacuuccgguucgacuccugggugaaccaguucuacacccucgcgcccauggggaacggcaccggccgccgccgguga

SEQ ID NO: 12585 - RNA, 1617 nt, Artificial Sequence
  derived and/or modified sequence opt1 from VP1__Norovirus_and/or_Norovirus-like__KX514172
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcagcaagcccuucuccguccccgugcugacgguggaggagaugaccaacagccgguuccccgccacccuggacaagcuguucaccggccccuccagcacguucgucgugcagccccagaacgggcgcugcaugaucgacggcguccugcuggggaccacccagcucuccccggugaacaucugcaccuuccggggcgacgugacgcacccccgcgacagccagaucuacaccaugaaccuggccagccccaacuggaacaacuacgacccgaccgaggagauccccgcgccccugggcacccccgacuucgucgggaagauccagggcaugcucacgcagaccaccaagggggagggcuccacccgggggcaccgcgccacgguguacgugggcagcgccaacuacgccccgaagcugggccggguccaguucgagaccgacaccaccaacgaccuggacgcccaccagaacacgaaguucacccccgugggggugguccagggcggggagucccccaagggcagcgagccccagcagugggugcucccguccuacagcgggcgcgacacccccaacgugcaccuggcccccgcggucgcccccaccuucccgggcgagcagcuccucuucuuccgguccacgauccccggcugcgggggccaccccaacaugaaccuggacugccugcucccccaggagugggugcagcacuucuaccaggaggccgccccggcgcagagcgacguggcccugcugcgcuucgucaaccccgacaccucccggguccucuucgagugcaagcugcacaagagcggguacgugaccguggcccacaccggccagcacgaccuggugaucccgcccaacggguacuuccgcuucgacuccugggugaaccaguucuacacgcucgcccccaugggcaacggcaccgggcggaagcgcuga

SEQ ID NO: 12586 - RNA, 1617 nt, Artificial Sequence
  derived and/or modified sequence opt1 from VP1__Norovirus_and/or_Norovirus-like__KX354114
augaagauggccagcuccgacgccaaccccagcgacggcuccgcggccaaccuggugccggaggccaacaacgaggucauggcccucgagcccguggccggggcggcccuggccgcccccguggcgggccagcagaacgucaucgaccccuggauccgcaacaacuucgugcaggcccccgggggcgaguucaccaucagcccccggaacgcccccggggagauccugugguccgcgccccucggcccggaccugaaccccuaccugagccaccucgcccgcauguacaacggcuacgccgggggcuucgaggugcaggucauccuggccgggaacgccuucaccgccggcaaggugaucuucgccgcggugccgcccaacuucccgacguccgggcugagccccucccaggucaccauguuccccagcgugguggucgacgugcggcagcucgagcccgugcugaucccgcugcccgacguccgcaacaacuucuaccacuacaaccaguccaacgaccccaccaucacccucaucgccaugcuguacacgccccugcgggccaacaacgccggcgacgacguguucaccgugagcugccgcguccucacccggccgucccccgacuucgacuucaucuuccuggugccgcccaccguggagagccgcacgaagcccuucuccguccccgugcugaccguggaggagaugaccaacagccgguuccccaucccccucgagcgccuguucaccggcccguccagcgccuucgucgugcagccccagaacgggcggugcacgaccgacggcguccugcucgggaccacccagcugucccccgugaacaucugcacguuccgcggcgacaucauccacaucaccggcagccacaacuacaccaugaaccuggcgagccagaacuggaacaacuacgacccgaccgaggagauccccgcgccccucgggacgcccgacuucgugggcaagauccaggggguccugacccagaccacccggggcgacggguccacgcgcggccacaaggccaccguguacaccggcagcgccgacuucaucccgaagcuggggcgggugcaguucgagaccgacacgaaccacgacuucgaggccaaccagaacaccaaguucacccccgucggcgugauccaggacggguccaccacgcaccgcaacgagccccagcagugggugcuccccagcuacuccggccggaacacccacaacguccaccuggccccggccguggcccccaccuuccccggggagcagcuccucuucuuccgcagcaccaugcccggcugcuccggcuacccgaacauggaccuggacugccugcucccccaggagugggugcaguacuucuaccaggaggccgcgcccgcccagagcgacgucgcccugcugcgguucgugaaccccgacacggggcgcgugcuguucgagugcaagcugcacaaguccggcuacaucaccgucgcccacaccgggcagcacgaccuggugaucccgcccaacggcuacuuccgguucgacagcugggugaaccaguucuacacccucgcccccauggggaacggcaccggccgcaagcgcuga

SEQ ID NO: 12587 - RNA, 1617 nt, Artificial Sequence
  derived and/or modified sequence opt1 from VP1__Norovirus_and/or_Norovirus-like__KX514295
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugaaccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcagcaagcccuucuccguccccgugcugacgguggaggagaugaccaacagccgguuccccgccacccuggacaagcuguucaccggccccuccagcacguucgucgugcagccccagaacgggcgcugcaugaucgacggcguccugcuggggaccacccagcucuccccggugaacaucugcaccuuccggggcgacgugacgcacccccgcgacagccccaucuacaccaugaaccuggccuccccgaacuggaacaacuacgaccccaccgaggagauccccgcgccccugggcaccccggacuucgucgggaagauccagggcaugcucacgcagaccaccaagggggagggcagcacccgggggcaccgcgccacgguguacgugggcagcgccaacuacgcccccaagcugggccggguccaguucgagaccgacaccaccaacgaccuggacgcccaccagaacacgaaguucacccccgugggggugguccagggcggggagucccccaagggcagcgagccgcagcagugggugcuccccuccuacagcgggcgcgacacccccaacgugcaccuggcccccgcggucgccccgaccuuccccggcgagcagcuccucuucuuccgguccacgauccccggcugcgggggccaccccaacaugaaccuggacugccugcucccgcaggagugggugcagcacuucuaccaggaggccgcccccgcgcagagcgacguggcccugcugcgcuucgucaaccccgacaccucccggguccucuucgagugcaagcugcacaagagcggguacgugaccguggcccacaccggccagcacgaccuggugaucccgcccaacggguacuuccgcuucgacuccugggugaaccaguucuacacgcucgcccccaugggcaacggcaccgggcggaagcgcuga

SEQ ID NO: 12588 - RNA, 1617 nt, Artificial Sequence
  derived and/or modified sequence opt1 from VP1__Norovirus_and/or_Norovirus-like__KX514242
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcagcaagcccuucuccguccccgugcugaccguggaggagaugacgaacagccgguuccccgccacccuggacaagcuguucaccggccccuccagcaccuucgucgugcagccccagaacgggcgcugcaugaucgacggcguccugcuggggacgacccagcucuccccggugaacaucugcaccuuccggggcgacgugacccacccccgcgacagccccaucuacacgaugaaccuggccagcccgaacuggaacaacuacgaccccaccgaggagauccccgcgccccugggcaccccggacuucgucgggaagauccagggcaugcucacccagacgaccaagggggagggcuccacccgggggcaccgcgccaccguguacgugggcagcgccaacuacgcccccaagcugggccggguccaguucgagacggacaccaccaacgaccuggacgcccaccagaacaccaaguucacgcccgugggggugguccagggcggggagagcccccagcgcuccgagccgcagcagugggugcuccccuccuacagcggccgggacacccccaacgugcaccuggcccccgcggucgccccgaccuuccccggggagcagcuccucuucuuccgcuccaccauccccggcugcggcgggcaccccaacauggaccuggacugccugcucccgcaggagugggugcagcacuucuaccaggaggccgcccccgcgcagagcgacguggcccugcugcgguucgucaaccccgacacgucccgcguccucuucgagugcaagcugcacaagagcggcuacgugaccguggcccacaccgggcagcacgaccuggugaucccgcccaacggcuacuuccgguucgacuccugggugaaccaguucuacacccucgcccccauggggaacggcacgggccgcaagcgcuga

SEQ ID NO: 12589 - RNA, 1617 nt, Artificial Sequence
  derived and/or modified sequence opt1 from VP1__Norovirus_and/or_Norovirus-like__KX514224
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacguguucaccgccggcaagaucaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaacgcgggcgacgacguguucaccgucagcugccgcgugcugacccggcccuccccggacuucgacuucaucuuccucgugccgcccaccgucgagagccgcuccaagcccuucagcgugcccgugcugaccgucgaggagaugacgaacucccgguuccccgccacccuggacaagcuguucaccggccccagcuccaccuucgugguccagccccagaacgggcgcugcaugaucgacggcgugcugcuggggacgacccagcucagcccggugaacaucugcaccuuccggggcgacgucacccacccccgcgacucccccaucuacacgaugaaccuggccagcccgaacuggaacaacuacgaccccaccgaggagauccccgcgccccugggcaccccggacuucguggggaagauccagggcaugcucacccagacgaccaagggggagggcagcacccgggggcaccgcgccaccguguacgucggcuccgccaacuacgcccccaagcugggccgggugcaguucgagacggacaccaccaacgaccuggacgcccaccagaacaccaaguucacgcccgugggggucgugcagggcggggagagcccccagcgcuccgagccgcagcagugggugcuccccagcuacuccggccgggacacccccaacguccaccuggcccccgccguggcgccgaccuuccccggggagcagcuccucuucuuccgcagcaccauccccggcugcggcgggcaccccaacaugaaccuggacugccugcucccgcaggagugggugcagcacuucuaccaggaggccgcccccgcccaguccgacgucgcgcugcugcgguucgugaaccccgacacgagccgcguccucuucgagugcaagcugcacaaguccggcuacgugaccguggcccacaccgggcagcacgaccuggugaucccgcccaacggcuacuuccgguucgacagcugggucaaccaguucuacacccucgcccccauggggaacggcacgggccgcaagcgcuga

SEQ ID NO: 12590 - RNA, 1617 nt, Artificial Sequence
  derived and/or modified sequence opt1 from VP1__Norovirus_and/or_Norovirus-like__KX514262
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcagcaagcccuucuccguccccgugcugacgguggaggagaugaccaacagccgguuccccgccacccuggacaagcuguucaccggccccuccagcgccuucgucgugcagccccagaacgggcgcugcaugaucgacggcguccugcuggggacgacccagcucuccccggugaacaucugcaccuuccggggcgacgugacccacccccgcgacagccccaucuacacgaugaaccuggccagcccgaacuggaacaacuacgaccccaccgaggagauccccgcgccccugggcaccccggacuucgucgggaagauccagggcaugcucacccagacgaccaagggggagggcuccacccgggggcaccgcgccaccguguacgugggcagcgccaacuacgcccccaagcugggccggguccaguucgagacggacaccaccaacgaccuggacgcccaccagaacaccaaguucacgcccgugggggugguccagggcggggagucccccaagggcagcgagccgcagcagugggugcuccccuccuacagcgggcgcgacacccccaacgugcaccuggcgcccgccgucgccccgaccuuccccggcgagcagcuccucuucuuccgguccaccauccccggcugcgggggccaccccaacaugaaccuggacugccugcucccgcaggagugggugcagcacuucuaccaggaggccgcgcccgcccagagcgacguggcccugcugcgcuucgucaaccccgacacgucccggguccucuucgagugcaagcugcacaagagcggguacgugaccguggcccacaccggccagcacgaccuggugaucccgcccaacggguacuuccgcuucgacuccugggugaaccaguucuacacccucgcccccaugggcaacggcacggggcggaagcgcuga

SEQ ID NO: 12591 - RNA, 1617 nt, Artificial Sequence
  derived and/or modified sequence opt1 from VP1__Norovirus_and/or_Norovirus-like__KX354139
augaagauggccagcuccgacgccaaccccagcgacggcuccgcggccaaccuggugccggaggccaacaacgaggucauggcccucgagcccguggccggggcggcccuggccgcccccguggcgggccagcagaacgucaucgaccccuggauccgcaacaacuucgugcaggcccccgggggcgaguucaccaucagcccccggaacgcccccggggagauccugugguccgcgccccucggcccggaccugaaccccuaccugagccaccucgcccgcauguacaacggcuacgccgggggcuucgaggugcaggucauccuggccgggaacgccuucaccgccggcaaggugaucuucgccgcggugccgcccaacuucccgacgaccgggcugucccccagccaggucaccauguuccccuccgugguggucgacgugcggcagcucgagcccgugaugaucccgcugcccgacguccgcaacaacuucuaccacuacaaccagagcaacgaccccaccaucacgcugaucgccaugcucuacacgccccugcgggccaacaacgccggcgacgacguguucaccguguccugccgcguccugacccggccgagccccgacuucgacuucaucuuccucgugccgcccaccguggagucccgcaccaagcccuucagcguccccgugcugaccguggaggagaugaccaacucccgguuccccaucccccuggagcgccucuucacgggcccgagcuccgccuucgucgugcagccccagaacgggcggugcaccaccgacggcguccugcuggggaccacgcagcucagccccgugaacaucugcaccuuccgcggcgacgugacccacaucaccggcucccggaacuacacgaugaaccuggcgagccagaacuggaacaacuacgacccgaccgaggagauccccgcgccccuggggacccccgacuucgucggcaagauccaggggaugcucacccagacgacccgcaccgacggcagcacccgggggcacaaggccacgguguacaccggcuccgccgacuucgccccgaagcugggccgcgugcaguucgagaccgacaccgaccacgacuucgaggccaaccagaacacgaaguucacccccgucggggugauccaggacggcagcaccacccaccggaacgagccccagcagugggugcugcccuccuacagcgggcgcaacacgcacaacguccaccucgccccggccguggcccccaccuuccccggcgagcaggucaucuucauccgguccaccaugcccgggagcuccggcuacccgaacauggaccuggacugccugcucccccaggagugggugcaguacuucuaccaggaggcggcccccgcccagagcgacguggccaugauccgcuucgugaaccccgacaccggccggguccuguucgagugcaagcugcacaaguccggguacaucaccguggcccacacgggccagcacgaccucgugaucccgcccaacggguacuuccgcuucgacagcugggucaaccaguucuacacccuggcgcccaugggcaacgggaccggccgccggcgcuga

SEQ ID NO: 12592 - RNA, 1617 nt, Artificial Sequence
  derived and/or modified sequence opt1 from VP1__Norovirus_and/or_Norovirus-like__KX514215
augaagauggccagcaacgacgugaaccccuccgacggcagcaccgccaaccuggucccggaggugaacaacgaggugauggcgcucgagcccgucgugggggccgccaucgccgcccccguggcgggccagcagaacgucaucgaccccuggauccgcaacaacuucgugcaggcccccgggggcgaguucaccgugagcccccggaacgcccccggggagauccugugguccgcgccccugggcccgggccucaaccccuaccugucccaccuggcccgcauguacaacggguacgccggcggguucgagguccaggugauccucgccggcaacgccuucacggccgggaagaucaucuucgcggccgugccgcccaacuucccgaccgagggccugaaccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggccaacaacgccggcgacgacguguucaccgucuccugccgcgugcugacccggcccagcccggacuucgacuucaucuuccucgugccgcccaccgucgagucccgcagcaagcccuucuccgugcccgugcugacgguccaggagaugaccaacagccgguuccccgcgacccuggacaagcuguucaccgggcccuccagcacguucgugguccagccccagaacggccgcugcaugaucgacggggugcugcugggcaccacccagcucuccccggugaacaucugcaccuuccggggcgacgucacgcacccccgcgacagccccaucuacaccaugaaccuggccuccccgaacuggaacaacuacgaccccaccgaggagauccccgcgccccuggggaccccggacuucgugggcaagauccaggggaugcucacgcagaccaccaagggcgaggggagcacccggggccaccgcgccacgguguacgucggcagcgccaacuacgcccccaagcuggggcgggugcaguucgagaccgacaccaccaacgaccuggacgcccaccagaacacgaaguucacccccgugggcgucgugcagggcggggagagcccccagcgcuccgagccgcagcagugggugcuccccuccuacagcgggcgggacacccccaacguccaccuggcccccgccguggccccgaccuuccccggcgagcagcuccucuucuuccgcuccacgauccccggcugcgggggccaccccaacaugaaccuggacugccugcucccgcaggagugggugcagcacuucuaccaggaggcggcccccgcccagagcgacgucgcccugcugcgguucgugaaccccgacaccucccgcguccucuucgagugcaagcugcacaagagcggguacgugaccguggcgcacaccggccagcacgaccuggugaucccgcccaacggguacuuccgguucgacuccugggucaaccaguucuacacgcucgcccccaugggcaacggcaccgggcgcaagcgcuga

SEQ ID NO: 12593 - RNA, 1617 nt, Artificial Sequence
  derived and/or modified sequence opt1 from VP1__Norovirus_and/or_Norovirus-like__KX514367
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcagcaagcccuucuccguccccgugcugaccguggaggagaugaccaacagccgguuccccgccacccuggacaagcuguucacgggccccuccagcaccuucgucgugcagccccagaacgggcgcugcaugaucgacggcguccugcuggggaccacccagcucuccccggugaacaucugcacguuccggggcgacgugacccacccccgcgacagccccaucuacaccaugaaccuggccagcccgaacuggaacaacuacgaccccaccgaggagauccccgcgccccugggcacgccggacuucgucgggaagauccagggcaugcucacccagaccaccaagggggagggcuccacgcgggggcaccgcgccaccguguacgugggcagcgccgacuacgcccccaagcugggccggguccaguucgagaccgacaccacgaacgaccuggacgcccaccagaacaccaaguucacccccgugggggugguccagggcggggagucccccaagggcagcgagccgcagcagugggugcuccccucccacagcgggcgcgacacccccaacgugcaccuggcccccgccgucgcgccgacguuccccggcgagcagcuccucuucuuccgguccaccauccccggcugcgggggccaccccaacaugaaccuggacugccugcucccgcaggagugggugcagcacuucuaccaggaggccgcccccgcccagagcgacguggcgcugcugcgcuucgucaaccccgacaccucccggguccucuucgagugcaagcugcacaagagcggguacgugaccguggcccacacgggccagcacgaccuggugaucccgcccaacggguacuuccgcuucgacuccugggugaaccaguucuacacccucgcccccaugggcaacggcaccgggcggaagcgcuga

SEQ ID NO: 12594 - RNA, 1617 nt, Artificial Sequence
  derived and/or modified sequence opt1 from VP1__Norovirus_and/or_Norovirus-like__KX514243
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugacgguggaggagaugaccaacucccgguuccccgccacccuggacaagcuguucaccggccccagcuccaaccucgucgugcagccccagaacgggcgcugcaugaucgacggcguccugcucgggacgacccagcugagcccggugaacaucugcaccuuccggggcgacgugacccacccccgcgacucccccaucuacacgaugaaccuggccagcccgaacuggaacagcuacgaccccaccgaggagacccccgcgccccucggcaccccggacuucgucgggaagauccacggcaugcugacgcagaccacccagggguccggcagcacccgggcccaccgcgccacgguguacgucgggggcgccgaguucacccccaagcugggcaaggugcaguucaagaccgagaccgaccacgaccucuccauccggcagaacacgaaguucacccccgugggggugguccagggcggggagagcccccagcgcuccgagccgcagcagugggugcugcccagcuacuccggccgggacacccccaacgugcaccuggcccccgccgucgcgccgaccuuccccggggagcagcuccuguucuuccgcagcacgauccccggcugcggcgggcaccccaacaugaaccuggacugccuccugccgcaggagugggugcagcacuucuaccaggaggccgcccccgcccaguccgacguggcgcugcuccgguucgucaaccccgacaccagccgcgugcuguucgagugcaagcugcacaaguccggcuacgugaccgucgcccacaccgggcagcacgaccucgugaucccgcccaacggcuacuuccgguucgacagcugggugaaccaguucuacacgcuggcccccauggggaacggcaccggccgcaagcgcuga

SEQ ID NO: 12595 - RNA, 1617 nt, Artificial Sequence
  derived and/or modified sequence opt1 from VP1__Norovirus_and/or_Norovirus-like__KX353996
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucagcguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagccccgugaacaucugcacguuccggggcgacgugacccacauccccggcucccgcaacuacaccaugaaccuggccagccagaacuggaacagcuacgacccgaccgaggagauccccgcgccccuggggacgcccgacuucgucggcaagauccagggggugcucacccagaccacccggacgaacggcuccacccgcgggcacaaggccaccguguacaccggcagcgccgacuucuccccgaagcugggccggguccaguucgccacggacaccgacaacgacuucgagaccaaccagaacaccaaguucacgcccgugggggugauccaggacggcagcaccacgccccgcaacgagccccagcaguggguccugccguccuacagcgggcggaacacccacaacgugcaccucgcccccgccguggcccccaccuuccccggcgagcagcugcuguucuuccgcuccaccaugccggggugcagcggcuaccccaacauggaccucgaccggcugccgccccaggagcgcguccaguacuucuaccaggaggcggcccccgcccaguccgacguggcccugcuccgguucgugaaccccgacaccggccgcguccuguucgagugcaagcugcacaagagcggguacgugaccguggcgcacaccggccagcacgaccucgucaucccgcccaacggguacuuccgcuucgacuccugggugaaccaguucuacacgcuggcccccaugggcaacgggaccggccggcgccgguga

SEQ ID NO: 12596 - RNA, 1617 nt, Artificial Sequence
  derived and/or modified sequence opt1 from VP1__Norovirus_and/or_Norovirus-like__DQ078820
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugggccccucccaggugaccauguucccccacaucaucgucgacgugcggcagcuggagcccgugcucaucccgcugcuggacguccgcaacaaccucuaccacuacaaccagagcaacgaccccaccaucaagcugaucgccaugcuguacacgccccuccgggccaacaacgcgggcgaggugguguucaccgucuccugccgcgugcugacccggcccagcccggacuucgacuucaucuuccuggugccgcccaccgucgagucccgcacgaagcccuucaccgugcccauccucaccgccgaggagaugaccaacagccgguuccccacgccccuggggaagcuguucaccggccccuccagcgccuucgugguccagccgcagaacgggcgcugcgccaccgacggcgugcuccugggcaccacgcagcugucccccgucaacaucugcaccuuccgcggggacgugacccacaucgccggcacccacgacuacacgaugaaccucgcgagccagaacuggaacaacuacgaccccaccgaggagaucccggcgccccuggggacccccgacuucgugggcaagauccaggggguccugacccagacgacccggggcgacggcuccacccgggggcacaaggccaccgugagcacgggcuccgugcacuucacccccaagcucgggggcguccaguucaccaccgacacgaacaacgacuucgagaccgggcagaacaccaaguucaccccggugggcgugauccaggacggcaacagcacgcaccagaacgagccccagcaguggguccugcccaacuacagcgggcgcaccggccacaacgugcaccuggcccccgccguggccccgaccuuccccggggagcagcuccuguucuuccgguccaccaugcccggcugcagcggguaccccaacaugaaccuggacugccuccugccgcaggaguggguccagcacuucuaccaggaggccgcccccgcccaguccgacguggcgcugcuccgcuucgugaaccccgacgccggccggguccuguucgagugcaagccccacaagagcggcuacgugaccguggcccacacggggcagcacgaccuggucaucccgcccaacggcuacuuccgcuucgacuccugggugaaccaguucugcacccucgcccccauggggaacggcaccggccggcgccgguga

SEQ ID NO: 12597 - RNA, 1617 nt, Artificial Sequence
  derived and/or modified sequence opt1 from VP1__Norovirus_and/or_Norovirus-like__AB933738
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccuguucccccuggcccgcaaggugaagggcuacgccgggggcuucgagguccaggugauccucgccgggaaggccuuccccgcgggcaagaucaucuucgccgccuccccgcccaacuuccccacggaggggcugagccccucccaggugaccauguucccgcacaucaucgucgacgugcggcagcuggagcccgugcucaucccccugcccgacguccgcaacaacuucuaccacuacaaccagagcaacgacuccaccaucaagcugaucgccaugcucuacaccccgcugcgggccaacaacgcgggcgaggacguguucacggugagcugccgcguccugacccggcccucccccgacuucgacuucaucuuccucgugcccccgaccguggagagccgcaccaagcccuucuccguccccauccugacgguggaggagaugaccaacagccgguuccccaucccgcuggagaagcuguucaccggccccuccagcaccuucgugguccagccccagaacgggcgcugcacgaccgacggcgugcuccuggggaccacccagcucuccccggucaacaucugcacguuccggggcgacgugacccacaucgccggcagccgcaacuacaccaugaaccuggccucccagaacuggaacagcuacgaccccaccgaggagauccccgcgccccuggggacgccggacuucgugggcaagauccaggggguccucacccagaccacccggcgcgacggcagcacgcgggggcacaaggccaccguguacaccggcuccgccgacuucagccccaagcugggccgcgugcaguucgccaccgacacggacaacgacuucgacacccaccagaacaccaaguucacccccgucggggugauccaggacggcgggacggcccaccggaacgagccccagcagugggugcugccguccuacagcggccgcaacacccacaacguccaccucgcccccgccguggcgcccaccuuccccggggagcagcugcuguucuuccgguccaccaugccgggcugcagcggcuaccccaacauggaccucgacugccugcugccccaggagugggugcaguacuucuaccaggaggccgcccccgcccaguccgacgucgcgcuccugcgcuucgugaacccggacacggggcgggugcuguucgagugcaagcuccacaagagcggcuacgucaccguggcccacaccgggcagcacgaccuggugaucccgcccaacggcuacuuccgcuucgacuccugggucaaccaguucuacacccuggcccccauggggaacggcaccggccgccggcgcuga

SEQ ID NO: 12598 - RNA, 1617 nt, Artificial Sequence
  derived and/or modified sequence opt1 from VP1__Norovirus_and/or_Norovirus-like__EU780734
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccacgaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcaccaagcccuucagcguccccauccugaccguggaggagaugaccaacucccgguuccccaucccccuggagaagcuguucacgggcccgagcuccgccuucgugguccagccccagaacgggcgcugcaccaccgacggcgugcuccuggggaccacgcagcucagccccgucaacaucugcaccuuccggggcgacgugacccacaucgccggcacccagaacuacacgaugaaccuggccucccagaacuggaacaacuacgacccgaccgaggagauccccgcgccccuggggacccccgacuucgugggcaagauccaggggguccucacccagacgacccgccgggacggcagcacccgcgggcacaaggccaccguguccacgggcagcauccacuucacccagagcugggccguguucaacuccccgcugauccaggccaugacccugaagcucgccaagacccgggacagcccccaguccgucguggugcaggacggcagcacgacccaccagaacgagccccagcaguggguccugcccgacuacuccgggcgcgacagcuacaacgugcaccuggccccggcgguggcccccaccuuccccggcgagcagcuccuguucuuccgguccaccaugcccgggugcagcggcuacccgaacaugaaccuggacugccuccugccccaggaguggguccagcacuucuaccaggaguccgcccccgcccagagcgacguggcgcugcuccgcuucgugaaccccgacacggggcggguccuguucgagugcaagcugcacaaguccggcuacgugaccguggcccacaccggccagcacgaccucgucaucccgcccaacggguacuuccgcuucgacagcugggugaaccaguucuacacccuggcccccaugggcaacggggccggccggcgccgcuga

SEQ ID NO: 12599 - RNA, 1617 nt, Artificial Sequence
  derived and/or modified sequence opt1 from VP1__Norovirus_and/or_Norovirus-like__KP064096
auggccagcaaggacgcccccaccaacauggacggcaccuccggggcgggccagcuggugccggaggccaacacggccgagcccaucagcauggagcccgucgccggggccgugaccgcggccgccaccgccggccaggugaacaugaucgaccccuggaucaugaacaacuacguccaggcgccgcagggggaguucaccaucucccccaacaacacgcccggcgacauccucuucgaccugcagcugggcccccaccucaacccguuccugagccaccuggcccagauguacaacgggugggugggcaacaugaaggugcgcguccuccuggccgggaacgccuucaccgccggcaagaucaucaucuccugcaucccgcccggguucguggcgcagaacaucagcaucgcccaggccaccauguucccccacgugaucgccgacguccgggugcuggagcccaucgaggugccccucgaggacguccgcaacgugcuguuccacaacaacgacaacacccccacgaugcggcuggugugcauccucuacacgccccugcgcgccuccggcagcuccagcggcaccgacccguucgucaucgcggggcgggugcugaccugccccucccccgacuucagcuuccucuuccuggugcccccgaacgucgagcagaagaccaagcccuucuccgugcccaaccugccccucaacacccugagcaacucccgcgugccgagccugaucaaguccaugauggucagccgggaccacggccagauggugcaguuccagaacgggcgcgugacccucgacggccagcugcagggcaccacgcccaccuccgccagccagcugugcaagauccgggggagcgucuuccacgccaacggcgggaacggcuacaaccucaccgagcuggacgggucccccuaccacgccuucgagagccccgccccgaucggcuuccccgaccugggcgagugcgacuggcacauggaggcgucccccaccacgcaguucaacaccggggacgugaucaagcagaucaacgucaagcaggagagcgccuucgccccgcaccucggcaccauccaggccgacgggcuguccgacgugagcgugaacaccaacaugaucgccaagcugggcugggucucccccgugagcgacgggcacaagcgcgacguggaccccugggucaucccccgguacggcuccacgcucaccgaggcggcccagcuggccccgcccaucuacccgcccggcuucggggaggccaucguguucuucaugagcgacuuccccaucgcgcacggcaccaacgggcuguccgugcccugcaccaucccccaggaguucgucacgcacuucgugaacgagcaggcccccacccgcggcgaggccgcccuccugcacuaccuggacccggacacccaccggaaccucggggaguucaagcuguaccccgacggcuucaugaccugcgugcccaacacgagcggcaccgggccccagacccugccgaucaacggcgucuucguguucguguccugggucagccgcuucuaccagcucaagcccguggggaccgccggccccgcgcggcgccuguga

SEQ ID NO: 12600 - RNA, 1617 nt, Artificial Sequence
  derived and/or modified sequence opt1 from VP1__Norovirus_and/or_Norovirus-like__KC473548
augaugauggccagcaaggacgcccccaccaacauggacggcaccuccggggcgggccagcuggugccggaggccaacacggccgagccccuccccaucaagcccgucgccggggccgcgaccgccguggccaccgccggccaggugaacaugaucgacccguggaucaugaacaacuucguccaggcgccccagggggaguucaccaucagccccaacaacacgcccggcgacauccuguucgaccugcagcucggcccgcaccugaaccccuuccuggcccaccucucccgcauguacaacgggugggugggcaacaugcagguccggaucaugcuggccgggaacgccuucagcgccggcaagaucaucgugugcugcaucccgcccggguucuccagccaguccaucagcaucgcgcaggccaccauguucccccacgugaucgccgacgugcgcguccuggagcccaucgacgugccccucgacgacgugcggaacguccuguuccacaacaacgacaacccccagaccaugcgccugcucugcaugcuguacaccccgcugcgguccggcggcacgagcuccgggaccgaccccuucgugaucgccggccgcgugcugaccugccccacccccgacuucagcuuccucuuccuggucccgcccgacaucgagcagcggacgaagcccuucuccgugcccaacaucccgaugaaccucaugagcaacucccgcgugagcaugcugaucgacgggaugauggucuccaacgaccagaaccaggugccccaguuccagaacggccgggugacccuggacggccagcuccaggggaccaccacggucagcgccgcgugcguggcccgcaugcggggccgcaucuucaacaacaacgggaacuacggcgugaaccugaccgagcuggacgggaaccccuaccacgccuucgacucccccgccccgcucggcuuccccgacuucggcaacugcgaccugcacaugaccuucgucaagaucaaccccaacgagcugagcagcggggacccguccggcaagguggucauccggagcuacgacgccaccuucgcgccccaccucgggacggugaagcuggagaacgacgacgagcuggcccgcuucgugggcaaggaggucgugcucgagcugaccuggguguccaaccgggagggggccacccugaaccucugggccguccccaacuacggcagcucccugacccaggccagccagcuggcgcccccgaucuacccgcccggcuucggggaggccaucguguacuucacguccaccuuccccaccgugagcaaccccaagguccccugcacccucccccaggaguucgugucccacuucgugaacgagcaggcccccacgcgcggcgacgccgcgcugcugcacuacgucgacccggacacccaccggaaccucggggaguucaagauguaccccgagggcuacaugaccugcgugcccaacgccgggggcggcccccagacccugccgaucaacgggguguucgucuucaucagcugggugucccgcuacuaccagcugaagcccgugggcacggccggggccgcccggcgccucuga

SEQ ID NO: 12601 - RNA, 1617 nt, Artificial Sequence
  derived and/or modified sequence opt1 from VP1__Norovirus_and/or_Norovirus-like__AB684698
auggccagcaaggacgcccccuccaacauggacggcaccagcggggcgggccagcuggugccggaggccaacaccgccgagcccaucaacauggaguccgucgugggggccgccacggcgaccgccaccgccggccaggugaaccucaucgaccccuggaucaugaacaacuacguccaggcgccccagggggaguucaccaucagcccgaacaacacgcccggcgacgugcuguucgaccugcagcucggcccccaccugaaccccuuccugucccaccucagccgcauguacaacgggugggugggcaacaugaagguccgggugaugcuggccgggaacgccuucuccgccggcaagaucaucaucugcugcaucccgcccggguucaccagccaguccaucagcaucgcccaggccaccauguucccccacgugaucgcggacguccgcgugcuggagcccaucgacgugccgcucgacgacguccggaacgugcuguuccacaacaacgacaacgcccagaccaugcgccugcucugcaugcuguacacgccccugcggaccggcgccuccagcuccggcagcgaccccuucgugaucgccgggcgcguccugaccugccccacccaggacuucaacuuccucuuccuggugccgcccgacguggagcagaagacgaagcccuucuccguccccaacaucccgcucaaccugaugagcaacucccgggugcccgcccugaucgacggcaugaccgugagcuccgaccagaaccaggucgugcaguuccagaacgggcgcgugacccucgacggccagcugcagggcaccacggcggucagcgccagcugcguggccaagauccgggggcgcaucuucuccaacgccagccacuacggcaucaaccugaccgaggucgacgggacccaguaccacgccuucgacucccccgcgccccucggcuucccggacuucgggaacugcgacuggcacgugaccggcacgaaggccagccagggcgaccugcagaccgacaaccccaccaucuccgggaccaucaagagcuacgaguccagcuucgcgccccaccugggcacggugcggaucgagggggacgacaacgagcucgcccgcuucaacggcaaggacguccugcugaaccucaccugguucucccagcggaacgggagccagcugaaccuguggaccauccccuccuacggcagcaaccucaccgaggccucccagcuggccccgcccaucuacccgcccggcuucggggaggccaucguguacuucacgagcaccuuccccgccaucucccgccccagcgugcccugcaccaugccgcaggaguucgucucccacuucgugaacgagcaggcccccacccggggcgaggcggcccugcuccacuaccuggaccccgacacgcaccgcaaccugggggaguucaagauguaccccgagggcuucuucacgugcgugccgaacgccgggggcagcggcccccagacccuccccaucaacggggucuucguguucguguccugggucagccgguacuaccagcugaagcccgugggcaccguggggaugacccgccggcuguga

SEQ ID NO: 12602 - RNA, 1617 nt, Artificial Sequence
  derived and/or modified sequence opt1 from VP1__Norovirus_and/or_Norovirus-like__AF538679
augaagauggccagcaaggacgcccccaccaacauggacggcaccuccggggcgggccagcuggugccgggggccaacacggccgagccccuccccaucaagcccgucgccggcgccgcgaccgccguggccaccgccggccaggugaacaugaucgacccguggaucaugaacaacuucguccaggcgccccagggggaguucaccaucagccccaacaacacgcccggcgacauccuguucgaccugcagcucgggccgcaccugaaccccuuccuggcccaccucucccgcauguacaacggcuggguggggaacaugcagguccggaucaugcuggccggcaacgccuucagcgccgggaagaucaucgugugcugcaucccgcccggcuucuccagccaguccaucagcaucgcgcaggccaccauguucccccacgugaucgccgacgugcgcguccuggagcccaucgacgugccccucgacgacgugcggaacguccuguuccacaacaacgacaacccccagaccaugcgccugcucugcaugcuguacaccccgcugcgguccggcggggccagcuccggcacggaccccuucgugaucgccgggcgcgugcugaccugccccacccccgacuucagcuuccucuuccuggucccgcccgacaucgagcagcggaccaagcccuucuccgugcccaacaucccgaugaaccucaugagcaacucccgcgugcccaugcugaucgacggcaugauggucagcaacgaccagaaccaggugccccaguuccagaacggccgggugacgcuggacgggcagcuccagggcaccaccaccgucuccgcggccugcaucgcccgcaugcgggggcgcaucuucaacaacaacggcaacuacggggugaaccuggccgagcuggacggcaaccccuaccacgccuucgacagcccggcgccccucggcuuccccgacuucgggaacugcgaccugcacaugacguucgugaagaucaacccgaccgagcuguccaccggcgaccccagcgggaaggucgugauccacagcuacgacgccaccuucgcgccccaccucggcacggucaagcuggaggacaacaacgagcuggaccaguucguggggaaggaggugguccucgagcugaccuggguguccaaccggaccggcgccacccugaaccucugggccgugcccaacuacggcagcaaccugacgcaggccucccagcuggccccgcccaucuacccgcccggguucggcgaggccaucgucuacuucaccagcaccuuccccaccguguccaaccccaaggugcccugcacgcucccccaggaguucgucagccacuucgugaacgagcaggccccgacccgcggggacgcggcccugcugcacuacguggaccccgacacccaccggaaccucggcgaguucaagauguaccccgagggguacaugaccugcguccccaacgccggcggcgggccgcagacgcugcccaucaacggcguguucguguucaucuccugggucagccgcuacuaccagcugaagcccguggggaccgccggcgccgcgcggcgccucuga

SEQ ID NO: 12603 - RNA, 1617 nt, Artificial Sequence
  derived and/or modified sequence opt1 from VP1__Norovirus_and/or_Norovirus-like__JQ743332
augaugauggccagcaaggacgccucccagagcgcggacggcgccuccggggccggccagcuggugcccgaggucaacaccgccgacccgcuccccauggagcccguggccgggcccaccacggcgguggccaccgccggccaggucaacaugaucgacccguggaucgugaacaacuucgugcagagcccccagggggaguucaccaucucccccaacaacacccccggcgacauccuguucgaccugcagcucggcccgcaccugaaccccuuccugagccaccucucccagauguacaacgggugggucggcaacaugcgcgugcggauccugcuggccgggaacgcguucagcgccggcaagaucaucgugugcugcgucccgcccggguucacguccagcucccucaccaucgcccaggccacccuguucccccacgugaucgccgacgugcgcacccuggagcccaucgagaugccccucgaggacguccggaacgugcuguaccacacgaacgacaaccagcccaccaugcgccuggugugcaugcucuacaccccgcugcggaccggcggcgggagcggcaacuccgacagcuucgucguggcggggcgcgugcugacggcccccuccagcgacuucuccuuccucuuccuggucccgcccaccaucgagcagaagacccgggccuucaccgugcccaacaucccccugcagacgcucagcaacucccgcuuccccagccugauccagggcaugauccugagccccgacgccucccaggugguccaguuccagaacggccggugccucaucgacgggcagcugcugggcaccaccccggccaccagcgggcagcuguuccgcgugcggggcaagaucaaccagggggcgcgcacgcucaaccugaccgagguggacggcaagcccuucauggccuucgacucccccgcccccgucggcuucccggacuucgggaagugcgacuggcacaugcggaucagcaagacccccaacaacaccuccagcggcgaccccaugcgcuccgugagcguccagacgaacgugcagggguucgugccgcaccucggcuccauccaguucgacgaggucuucaaccaccccaccggggacuacaucggcaccaucgaguggaucagccagcccuccacgcccccgggcaccgacaucaaccugugggagauccccgacuacgggagcucccugagccaggccgccaaccucgcgccgcccguguucccgcccggcuucggggaggcccugguguacuucgucuccgccuuccccggccccaacaaccggagcgcccccaacgacgugcccugccugcucccccaggaguacaucacccacuucguguccgagcaggcccccaccaugggggacgcggcccugcugcacuacgucgacccggacaccaaccgcaaccucggcgaguucaagcuguaccccggcggguaccugacgugcgugcccaacggcgugggggccggcccccagcagcucccgcugaacggcgucuuccuguucgugagcugggugucccgguucuaccagcucaagcccgucgggaccgccagcaccgcgcgcuga

SEQ ID NO: 12604 - RNA, 1617 nt, Artificial Sequence
  derived and/or modified sequence opt1 from VP1__Norovirus_and/or_Norovirus-like__GQ856470
augaugauggccagcaaggacgcccccaccaacauggacggcaccuccggggcgggccagcuggugccggaggucagcacggccgagcccaucuccauggagcccguggccggggccgccaccgcggccgccaccgccggccaggugaacaugaucgaccccuggaucaugagcaacuacguccaggcgccgcagggggaguucaccaucucccccaacaacacgcccggcgacauccucuucgaccugcagcugggcccccaccucaacccguuccugagccaccuggcccagauguacaacgggugggugggcaacaugaaggugcgcguccuccuggccgggaacgccuucaccgccggcaagaucaucaucuccugcgugccgcccggguucgcggcccagaacgugagcaucgcccaggccaccauguucccccacgucaucgccgacgugcgggugcuggagcccaucgaggucccccucgaggacgugcgcaacgugcuguuccacaacaacgacuccacccccacgaugcggcugaucugcaugcucuacacgccccugcgcgcgagcggcuccagcuccggcaccgacccguucgucaucgccgggcgggugcugaccugccccagccccgacuucaacuuccucuuccuggugcccccgaacgucgagcagaagaccaagcccuucuccgugcccgaccugccccucaacgugcugagcaacucccgcgucccgagccugaucaaguccaugauggugagccaggaccacggccagauggugcaguuccagaacgggcgggucacccucgacggccagcugcagggcaccacccccacgagcgccucccagcugugcaagauccgcgggaccguguaccacgccaccggcgggcagggccucaaccugaccgagaucgacgggacgcccuaccacgccuucgagagccccgcgccgaucggcuuccccgaccugggcgagugcgacuggcacaucaacgccucccccgccaacgccuucaccgacgggagcaucauccaccggaucgacgucgugcaggacccgaccuucgcgccccaccucggcaccauccacuacacgaacgccaacuacgacgccaacgugucccugaucugcagccuggaguggcucuccccgcccagcgggggcgcccugaaggccaaccccugggcgaucccccgcuacggguccacccugaccgaggccgcccagcucgccccgcccaucuacccgcccggcuucggcgaggccaucgucuucuucaugagcgacuuccccaucgcgaacggguccgacggccugagcgugcccugcaccaucccccaggaguucgugacgcacuucgucaacgagcaggcccccacccgcggggaggccgcccugcuccacuacguggaccccgacacccaccggaaccugggcgaguucaagcuguaccccgagggguucaugaccugcgugccgaacuccagcggcuccggcccccagacgcuccccaucaacggggucuucaccuucaucagcugggugucccgguucuaccagcugaagcccgugggcaccaccgggccgguccgccggcuguga

SEQ ID NO: 12605 - RNA, 1617 nt, Artificial Sequence
  derived and/or modified sequence opt1 from VP1__Norovirus_and/or_Norovirus-like__JN603244
augaugauggccagcaaggacgcccccaccaacauggacggcaccuccggggcgggccagcuggugccggaggucagcacggccgagcccaucuccauggagcccguggccggggccgccaccgcggccgccaccgccggccaggugaacaugaucgaccccuggaucaugagcaacuacguccaggcgccgcagggggaguucaccaucucccccaacaacacgcccggcgacauccucuucgaccugcagcugggcccccaccucaacccguuccugagccaccuggcccagauguacaacgggugggugggcaacaugaaggugcgcguccuccuggccgggaacgccuucaccgccggcaagaucaucaucuccugcgugccgcccggguucgcggcccagaacgugagcaucgcccaggccaccauguucccccacgucaucgccgacgugcgggugcuggagcccaucgaggucccccucgaggacgugcgcaacgugcuguuccacaacaacgacuccacccccacgaugcggcugaucugcaugcucuacacgccccugcgcgcgagcggcuccagcuccggcaccgacccguucgucaucgccgggcgggugcugaccugccccagccccgacuucaacuuccucuuccuggugcccccgaacgucgagcagaagaccaagcccuucuccgugcccaaccugccccucaacgugcugagcaacucccgcgucccgagccugaucaaguccaugauggugagccaggaccacggccagauggugcaguuccagaacgggcgggucacccucgacggccagcugcagggcaccacccccacgagcgccucccagcugugcaagauccgcgggaccguguaccacgccaccggcgggcagggccucaaccugaccgagaucgacgggacgcccuaccacgccuucgagagccccgcgccgaucggcuuccccgaccugggcgagugcgacuggcacaucaacgccucccccgccaacgccuucaccgacgggagcaucauccaccggaucgacgucgcccaggacuccaccuucgcgccgcaccucggcaccauccacuacacgaacgccgacuacaacgccaacguggggcugaucugcagccuggaguggcucuccccgcccagcggcggggcccccaaggugaaccccugggcgaucccccgcuacggcuccacccugaccgaggccgcccagcuggccccgcccaucuacccgcccggcuucggggaggccaucgucuucuucaugagcgacuuccccaucgcgaacggcuccgacgggcucagcgugcccugcaccaucccccaggaguucgugacgcacuucgucaacgagcaggcccccacccggggcgaggccgcccugcugcacuacguggaccccgacacccaccgcaaccucggggaguucaagcuguaccccgagggcuucaugaccugcgugccgaacuccagcggcuccgggccccagacgcugcccaucaacggcgucuucaccuucaucagcugggugucccgguucuaccagcucaagcccguggggaccaccggcccgguccgccggcuguga

SEQ ID NO: 12606 - RNA, 1617 nt, Artificial Sequence
  derived and/or modified sequence opt1 from VP1__Norovirus_and/or_Norovirus-like__AB078335
augaugauggccagcaaggacgcgccccaguccgccgacggcgccagcggggccggccagcuggugccggaggucaacaccgccgacccccuccccauggagcccguggccgggccgaccacggcgguggccaccgccggccaggucaacaugaucgaccccuggaucgugaacaacuucgugcagagcccccagggggaguucaccaucucccccaacaacaccccgggcgacauccuguucgaccugcagcucggcccccaccugaaccccuuccugucccaccucagccagauguacaacgggugggucggcaacaugcgcgugcggauccugcuggccgggaacgcguucuccgccggcaagaucaucgugugcugcgugcccccgggguucacgagcuccagccucaccaucgcccaggccacccuguucccccacgucaucgccgacgugcgcacccuggagcccaucgagaugccccucgaggacguccggaacgugcuguaccacacgaacgacaaccagccgaccaugcgccuggugugcaugcucuacacgccccugcggaccggcggcggguccggcaacagcgacuccuucgucguggcggggcgcgugcugaccgcccccagcuccgacuucagcuuccucuuccuggugcccccgaccaucgagcagaagacccgggccuucaccguccccaacaucccccugcagacgcucuccaacagccgcuuccccucccugauccagggcaugauccugagcccggacgccagccaggugguccaguuccagaacggccggugccucaucgacgggcagcugcugggcaccacccccgccaccuccgggcagcuguuccgcgugcggggcaagaucaaccagggggcgcgcacgcucaaccugaccgagguggacggcaagcccuucauggccuucgacagccccgccccggucggcuuccccgacuucgggaagugcgacuggcacaugcggaucuccaagacccccaacaacaccagcuccggcgacccgaugcgcagcguguccguccagacgaacgugcagggguucgugccccaccucggcagcauccaguucgacgaggucuucaaccaccccaccggggacuacaucggcaccaucgaguggaucucccagcccagcaccccgcccggcacggacaucaaccugugggagauccccgacuacggguccagccugucccaggccgccaaccucgcgcccccgguguucccgcccggcuucggggaggcccugguguacuucgucagcgccuuccccggccccaacaaccgguccgcccccaacgacgugcccugccugcucccccaggaguacaucacccacuucgugagcgagcaggccccgaccaugggggacgcggcccugcugcacuacgucgaccccgacaccaaccgcaaccucggcgaguucaagcuguaccccggcggguaccugacgugcgugcccaacggcgugggggccggcccgcagcagcucccccugaacggcgucuuccuguucguguccugggugagccgguucuaccagcucaagcccgucgggaccgccuccaccgcgcgcuga

SEQ ID NO: 12607 - RNA, 1617 nt, Artificial Sequence
  derived and/or modified sequence opt1 from VP1__Norovirus_and/or_Norovirus-like__GU299761
augaugauggccagcaaggacgcccccaccaacauggacggcaccuccggggcgggccagcuggugccggaggccaacacggccgagccccuccccaucaagcccgucgccggggccgcgaccgccguggccaccgccggccaggugaacaugaucgacccguggaucaugaacaacuucguccaggcgccccagggggaguucaccaucagccccaacaacacgcccggcgacauccuguucgaccugcagcucggcccgcaccugaaccccuuccuggcccaccucucccgcauguacaacgggugggugggcaacaugcagguccggaucaugcuggccgggaacgccuucagcgccggcaagaucaucgugugcugcaucccgcccggguucuccagccaguccaucagcaucgcgcaggccaccauguucccccacgugaucgccgacgugcgcguccuggagcccaucgacgugccccucgacgacgugcggaacguccuguuccacaacaacgacaacccccagaccaugcgccugcucugcaugcuguacaccccgcugcgguccggcggcacgagcuccgggaccgaccccuucgugaucgccggccgcgugcugaccugccccacccccgacuucagcuuccucuuccuggucccgcccgacaucgagcagcggacgaagcccuucuccgugcccaacaucccgaugaaccucaugagcaacucccgcgugagcaugcugaucgacgggaugauggucuccaacgaccagaaccaggugccccaguuccagaacggccgggugacccuggacggccagcuccaggggaccaccacggucagcgccgcgugcguggcccgcaugcggggccgcaucuucaacaacaacgggaacuacggcgugaaccugaccgagcuggacgggaaccccuaccacgccuucgacucccccgccccgcucggcuuccccgacuucggcaacugcgaccugcacaugaccuucgucaagaucaaccccaacgagcugagcagcggggacccguccggcaagguggucauccacagcuacgacgccaccuucgcgccccaccucgggacggugaagcuggagaacgacgacgagcuggcccgguucgugggcaaggaggucgugcucgagcugaccuggguguccaaccgcgagggggccacccugaaccucugggccguccccaacuacggcagcucccugacccaggccagccagcuggcgcccccgaucuacccgcccggcuucggggaggccaucguguacuucacguccaccuuccccaccgugagcaaccccaagguccccugcacccucccccaggaguucgugucccacuucgugaacgagcaggcccccacgcggggcgacgccgcgcugcugcacuacgucgacccggacacccaccgcaaccucggggaguucaagauguaccccgagggcuacaugaccugcgugcccaacgccgggggcggcccccagacccugccgaucaacgggguguucgucuucaucagcugggugucccgguacuaccagcugaagcccgugggcacggccggggccgcccgccggcucuga

SEQ ID NO: 12608 - RNA, 1617 nt, Artificial Sequence
  derived and/or modified sequence opt1 from VP1__Norovirus_and/or_Norovirus-like__AJ277610
augaugauggccagcaagggcgcgccccaguccgccgacgggagcuccggcgccgggcagcuggugccggaggucaacaccgccgacccccuccccauggagcccguggccggcccgaccacggccguggcgaccgccgggcaggucaacaugaucgaccccuggaucgugaacaacuucgugcagagcccccagggcgaguucaccaucucccccaacaacaccccgggcgacauccuguucgaccugcagcucgggccccaccugaaccccuuccugagccaccucucccagauguacaacggcugggucgggaacaugcgcgugcggauccugcuggccggcaacgccuucagcgcggggaagaucaucgugugcugcgugcccccgggcuucacguccagcucccucaccaucgcccaggccacccuguucccccacgucaucgccgacgugcgcacccuggagcccaucgagaugccccucgaggacguccggaacgugcuguaccacacgaacgacagccagccgaccaugcgccuggugugcaugcucuacacgccccugcggaccggcgggggcuccgggaacagcgacuccuucgucguggccggccgcgugcugaccgcgcccagcuccgacuucagcuuccucuuccuggugcccccgaccaucgagcagaagacccgggccuucaccguccccaacaucccccugcagacgcucuccaacagccgcuuccccagccugauccagggcaugauccuguccccggacgccagccaggugguccaguuccagaacgggcggugccucaucgacggccagcugcuggggaccacccccgccaccuccggccagcuguuccgcgugcgggggaagaucaaccagggcgcccgcacgcucaaccugaccgagguggacggcaagcccuucauggcguucgacagccccgccccggucggguuccccgacuucggcaagugcgacuggcacaugcggguguccaagacccccaacaacaccagcuccggggacccgaugcgcagcgucuccgugcagacgaacgugcagggcuucgucccccaccucgggagcauccaguucgacgagguguucaaccaccccaccggcgacuacaucggcaccaucgaguggaucucccagcccagcaccccgcuggggacggacaucaaccugugggagauccccgacuacggcuccagccucucccaggccgccaaccuggccccgcccguguucccgcccggguucggcgaggcgcuggucuacuucgugagcgccuuccccgggcccaacaaccgguccgcccccaacgacgugcccugccuccugccccaggaguacaucacccacuucgucagcgagcaggcccccaccaugggcgacgccgcgcugcuccacuacguggacccggacaccaaccgcaaccugggcgaguucaagcuguaccccgggggcuaccucacgugcgugcccaacggggucggcgccggcccccagcagcugccgcugaacgggguguuccucuucguguccugggucagccgguucuaccagcugaagcccgugggcaccgccagcaccgcccgcuga

SEQ ID NO: 12609 - RNA, 1617 nt, Artificial Sequence
  derived and/or modified sequence opt1 from VP1__Norovirus_and/or_Norovirus-like__GQ856462
augaugauggccagcaaggacgcccccaccaacauggacggcaccuccggggcgggccagcuggugccggaggccaacacggccgagccccuccccaucaagcccgucgccggggccgcgaccgccguggccaccgccggccaggugaacaugaucgacccguggaucaugaacaacuucguccaggcgccccagggggaguucaccaucagccccaacaacacgcccggcgacauccuguucgaccugcagcucggcccgcaccugaaccccuuccuggcccaccucucccgcauguacaacgggugggugggcaacaugcagguccggaucaugcuggccgggaacgccuucagcgccggcaagaucaucgugugcugcaucccgcccggguucuccagccaguccaucagcaucgcgcaggccaccauguucccccacgugaucgccgacgugcgcguccuggagcccaucgacgugccccucgacgacgugcggaacguccuguuccacaacaacgacaacccccagaccaugcgccugcucugcaugcuguacaccccgcugcgguccggcggcacgagcuccgggaccgaccccuucgugaucgccggccgcgugcugaccugccccacccccgacuucagcuuccucuuccuggucccgcccgacaucgagcagcggacgaagcccuucuccgugcccaacaucccgaugaaccucaugagcaacucccgcgugagcaugcugaucgacgggaugauggucuccaacgaccagaaccaggugccccaguuccagaacggccgggugacccuggacggccagcuccaggacaccaccacggucagcgccgcgugcguggcccgcaugcgggggcgcaucuucaacaacaacggcaacuacggggugaaccugaccgagcuggacggcaaccccuaccacgccuucgacucccccgccccgcucggguuccccgacuucggcaacugcgaccugcacaugaccuucgucaagaucaaccccaacgagcugagcagcggcgacccguccgggaagguggucauccacagcuacgacgccaccuucgcgccccaccucggcacggugaagcuggagaacgacgacgagcuggcccgguucguggggaaggaggucgugcucgagcugaccuggguguccaaccgcgagggcgccacccugaaccucugggccguccccaacuacgggagcucccugacccaggccagccagcuggcgcccccgaucuacccgcccggcuucggcgaggccaucguguacuucacguccaccuuccccaccgugagcaaccccaagguccccugcacccucccccaggaguucgugucccacuucgugaacgagcaggcccccacgcgcggggacgccgcgcugcugcacuacgucgacccggacacccaccggaaccucggcgaguucaagauguaccccgagggguacaugaccugcgugcccaacgccggcgggggcccccagacccugccgaucaacggcguguucgucuucaucagcugggugucccgguacuaccagcugaagcccguggggacggccggcgccgcccgccggcucuga

SEQ ID NO: 12610 - RNA, 1617 nt, Artificial Sequence
  derived and/or modified sequence opt1 from VP1__Norovirus_and/or_Norovirus-like__AF435807
augaagauggccagcaaggacgcgccccaguccgccgacggcgccagcggggccggccagcuggugccggaggucaacaccgccgacccccuccccauggagcccguggccgggccgaccacggcgguggccaccgccggccaggucaacaugaccgaccccuggaucgugaacaacuucgugcagagcccccagggggaguucaccaucucccccaacaacacgccgggcgacauccuguucgaccugcagcucggcccccaccugaaccccuuccugucccaccucagccagauguacaacgggugggucggcaacaugcgcgugcggauccugcuggccgggaacgcguucuccgccggcaagaucaucgugugcugcgugcccccgggguucaccagcuccagccucaccaucgcccaggccacccuguucccccacgucaucgccgacgugcgcacgcuggagcccaucgagaugccccucgaggacguccggaacgugcuguaccacaccaacgacaaccagccgaccaugcgccuggugugcaugcucuacacgccccugcggaccggcggcggguccggcgacagcgacuccuucgucguggcggggaaggugcugaccgcccccagcuccgacuucagcuuccucuuccuggugcccccgaccaucgagcagaagacccgcgccuucacgguccccaacaucccccugcagacccucuccaacagccgguuccccucccugauccagggcaugauccugagcccggacgccagccaggugguccaguuccagaacggccgcugccucaucgacgggcagcugcugggcaccacccccgccacguccgggcagcuguuccgggugcgcggcaagaucaaccagggggcgcggacccucaaccugaccgagguggacggcaagcccuucauggccuucgacagccccgccccggucggcuuccccgacuucgggaagugcgacuggcacaugcgcaucuccaagacccccaacaacacgagcuccggcgacccgaugcggagcguguccguccagaccaacgugcagggguucgugccccaccucggcagcauccaguucgacgaggucuucaaccaccccaccggggacuacaucggcaccaucgaguggaucucccagcccagcacgccgcccggcaccgacaucaaccugugggagauccccgacuacggguccagccugucccaggccgccaaccucgcgcccccgguguucccgcccggcuucggggaggcccugguguacuucgucagcgccuuccccggccccaacaaccgcuccgcccccaacgacgugcccugccugcucccccaggaguacaucacccacuucgugagcgagcaggccccgaccaugggggacgcggcccugcugcacuacgucgaccccgacacgaaccggaaccucggcgaguucaagcuguaccccggcggguaccugaccugcgugcccaacggcgugggggccggcccgcagcagcucccccugaacggcgucuuccuguucguguccugggugagccgcuucuaccagcucaagcccgucgggaccgccuccaccgcgcgguga

SEQ ID NO: 12611 - RNA, 1617 nt, Artificial Sequence
  derived and/or modified sequence opt1 from VP1__Norovirus_and/or_Norovirus-like__KX396056
augaugauggccagcaaggacgcccccaccaacauggacggcaccuccggggcgggccagcuggugccggaggccagcacggccgagcccaucuccauggagcccgucgccggggccgcgaccgccgccgccaccgcgggccaggugaacaugaucgaccccuggaucaugagcaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugcgcgugcuccuggccgggaacgccuucaccgcgggcaagaucaucaucuccugcgucccgcccggguucgccgcccagaacgugagcaucgcccaggccaccauguucccccacgugaucgcggacguccgggugcuggagcccaucgaggugccccucgaggacguccgcaacgugcuguuccacaacaacgacuccacccccacgaugcggcugaucugcaugcucuacacgccccugcgcgccagcggcuccagcuccggcaccgacccguucgugaucgccgggcggguccugaccugccccagccccgacuucaacuuccucuuccuggugcccccgaacguggagcagaagaccaagcccuucuccguccccaaccugccccucaacgugcugagcaacucccgcgugccgagccugauccgguccaugauggucagccaggaccacggccagauggugcaguuccagaacgggcgcgugacccucgacggccagcugcagggcaccacccccacgagcgccucccagcugugcaagauccgggggaccgucuaccacgccaccggcgggcagggccucaaccugaccgagaucgacgggacgcccuaccacgcgcuggagagccccgccccgaucggcuuccccgaccucggcgagugcgacuggcacaucaacgccucccccgccaacgccuucaccgacgggagcaucauccaccgcaucgacguggcgcaggacuccaccuucgccccgcaccugggcaccauccacuacacgaacgccaacuacgacgccaacaucagccugaucugcucccucgaguggcugagcccgcccuccgggggcgcgcccaaggucaaccccugggccaucccccgguacgggagcacccugaccgaggccgcccagcucgccccgcccaucuacccgcccggcuucggcgaggcgaucguguucuucauguccgacuuccccaucgccaacgggagcgacggccuguccgugcccugcaccaucccccaggaguucgucacgcacuucgugaacgagcaggcccccacccgcggggaggccgcccugcuccacuacguggaccccgacacccaccggaaccugggcgaguucaagcuguaccccgagggguucaugaccugcgucccgaacagcuccggcagcggcccccagacgcuccccaucaacgggguguucaccuucaucuccugggugagccgcuucuaccagcugaagcccgucggcaccaccgggccggugcggcgccuguga

SEQ ID NO: 12612 - RNA, 1617 nt, Artificial Sequence
  derived and/or modified sequence opt1 from VP1__Norovirus_and/or_Norovirus-like__AB187514
augaugauggccagcaaggacgcccccaccaacauggacggcaccuccggggcgggccagcuggugccggaggccagcacggccgagcccaucuccauggagcccgucgccggggccgcgaccgccgccgccaccgcgggccaggugaacaugaucgaccccuggaucaugagcaacuacgugcaggccccgcagggggaguucaccaucucccccaacaacacgcccggcgacauccucuucgaccugcagcugggcccccaccucaacccguuccugagccaccuggcccagauguacaacgggugggucggcaacaugaaggugcgcgugcuccuggccgggaacgccuucaccgcgggcaagaucaucaucuccugcgucccgcccggguucgccgcccagaacgugagcaucgcccaggccaccauguucccccacgugaucgcggacguccgggugcuggagcccaucgaggugccccucgaggacguccgcaacgugcuguuccacaacaacgacuccacccccacgaugcggcugaucugcaugcucuacacgccccugcgcgccagcggcuccagcuccggcaccgacccguucgugaucgccgggcggguccugaccugccccagccccgacuucaacuuccucuuccuggugcccccgaacguggagcagaagaccaagcccuucuccguccccaaccugccccucaacgugcugagcaacucccgcgugccgagccugaucaaguccaugauggucagccaggaccacggccagauggugcacuuccagaucgggcgggugacccucgacggccagcugcagggcaccacccccacgagcgccucccagcugugcaagauccgcgggaccgucuaccacgccaccggcgggcagggccucaaccugaccgagaucgacgggacgcccuaccacgcguucgagagccccgccccgaucggcuuccccgaccugggcgagugcgacuggcacaucaacgccucccccgccaacgccuucaccgacgggagcaucauccaccggaucgacguggcgcaggacuccaccuucgccccgcaccucggcaccauccacuacacgaacgccaacuacgacgccaacgucagccugaucugcucccuggaguggcucagcccgcccuccgggggcgcgcccaaggugaaccccugggccaucccccgcuacgggagcacccugaccgaggccgcccagcuggccccgcccaucuacccgcccggcuucggcgaggcgaucguguucuucauguccgacuuccccaucgccaacgggagcgacggccucuccguccccugcaccaucccccaggaguucgugacgcacuucgugaacgagcaggcccccacccgcggggaggccgcccugcugcacuacgucgaccccgacacccaccggaaccucggcgaguucaagcuguaccccgagggguucaugaccugcgugccgaacagcuccggcagcggcccccagacgcugcccaucaacgggguguucaccuucaucuccugggucagccgguucuaccagcucaagcccgugggcaccaccgggccggugcgccggcuguga

SEQ ID NO: 12613 - RNA, 1617 nt, Artificial Sequence
  derived and/or modified sequence opt1 from VP1__Norovirus_and/or_Norovirus-like__L07418
augaugauggccagcaaggacgcgccccaguccgccgacggcgccagcggggccggccagcuggugccggaggucaacaccgccgacccccuccccauggagcccguggccgggccgaccacggcgguggccaccgccggccaggucaacaugaucgaccccuggaucgugaacaacuucgugcagagcccccagggggaguucaccaucucccccaacaacaccccgggcgacauccuguucgaccugcagcucggcccccaccugaaccccuuccugucccaccucagccagauguacaacgggugggucggcaacaugcgcgugcggauccugcuggccgggaacgcguucuccgccggcaagaucaucgugugcugcgugcccccgggguucacgagcuccagccucaccaucgcccaggccacccuguucccccacgucaucgccgacgugcgcacccuggagcccaucgagaugccccucgaggacguccggaacgugcuguaccacacgaacgacaaccagccgaccaugcgccuggugugcaugcucuacacgccccugcggaccggcggcggguccggcaacagcgacuccuucgucguggcggggcgcgugcugaccgcccccagcuccgacuucagcuuccucuuccuggugcccccgaccaucgagcagaagacccgggccuucaccguccccaacaucccccugcagacgcucuccaacagccgcuuccccucccugauccagggcaugauccugagcccggacgccagccaggugguccaguuccagaacggccggugccucaucgacgggcagcugcugggcaccacccccgccaccuccgggcagcuguuccgcgugcggggcaagaucaaccagggggcgcgcacgcucaaccugaccgagguggacggcaagcccuucauggccuucgacagccccgccccggucggcuuccccgacuucgggaagugcgacuggcacaugcggaucuccaagacccccaacaacaccggcagcggggacccgaugcgcuccgugagcguccagacgaacgugcagggcuucgugccccaccucggguccauccaguucgacgaggucuucaaccaccccaccggcgacuacaucggcaccaucgaguggaucagccagcccuccaccccgcccgggacggacaucaaccugugggagauccccgacuacggcagcucccugagccaggccgccaaccucgcgcccccgguguucccgcccggguucggcgaggcccugguguacuucgucuccgccuuccccgggcccaacaaccggagcgcccccaacgacgugcccugccugcucccccaggaguacaucacccacuucguguccgagcaggccccgaccaugggcgacgcggcccugcugcacuacgucgaccccgacaccaaccgcaaccucggcgaguucaagcuguaccccgggggcuaccugacgugcgugcccaacggggugggcgccggcccgcagcagcucccccugaacggggucuuccuguucgugagcugggugucccgguucuaccagcucaagcccgucggcaccgccagcaccgcgcgcuga

SEQ ID NO: 12614 - RNA, 1617 nt, Artificial Sequence
  derived and/or modified sequence opt1 from VP1__Norovirus_and/or_Norovirus-like__FJ515294
augaugauggccagcaaggacgcgccccaguccgccgacggcgccagcggggccggccagcuggugccggaggucaacaccgccgacccccuccccauggagcccguggccgggccgaccacggcgguggccaccgccggccaggucaacaugaucgaccccuggaucgugaacaacuucgugcagagcccccagggggaguucaccaucucccccaacaacaccccgggcgacauccuguucgaccugcagcucggcccccaccugaaccccuuccugucccaccucagccagauguacaacgggugggucggcaacaugcgcgugcggauccugcuggccgggaacgcguucuccgccggcaagaucaucgugugcugcgugcccccgggguucacgagcuccagccucaccaucgcccaggccacccuguucccccacgucaucgccgacgugcgcacccuggagcccaucgagaugccccucgaggacguccggaacgugcuguaccacacgaacgacaaccagccgaccaugcgccuggugugcaugcucuacacgccccugcggaccggcggcggguccggcaacagcgacuccuucgucguggcggggcgcgugcugaccgcccccagcuccgacuucagcuuccucuuccuggugcccccgaccaucgagcagaagacccgggccuucaccguccccaacaucccccugcagacgcucuccaacagccgcuuccccucccugauccagggcaugauccugagcccggacgccagccaggugguccaguuccagaacggccggugccucaucgacgggcagcugcugggcaccacccccgccaccuccgggcagcuguuccgcgugcggggcaagaucaaccagggggcgcgcacgcucaaccugaccgagguggacggcaagcccuucauggccuucgacagccccgccccggucggcuuccccgacuucgggaagugcgacuggcacaugcggaucuccaagacccccaacaacaccagcuccggcgacccgaugcgcagcguggacguccagacggacgugcagggguucgugccccaccucggcuccauccaguucgacgaggucuucaaccaccccaccggggacuacaucggcaccaucgaguggaucagccagcccuccaccccgcccggcacggacaucaaccugugggagauccccgacuacgggagcucccugagccaggccgccaaccucgcgcccccgguguucccgcccggcuucggggaggcccugguguacuucgucuccgccuuccccggccccaacaaccggagcgcccccaacgacgugcccugccugcucccccaggaguacgugacccacuucgucuccgagcaggccccgaccaugggggacgcggcccugcugcacuacguggaccccgacaccaaccgcaaccucggcgaguucaagcuguaccccggcggguaccugacgugcgugcccaacggcgucggggccggcccgcagcagcucccccugaacggcguguuccuguucgugagcugggucucccgguucuaccagcucaagcccguggggaccgccagcaccgcgcgcuga

SEQ ID NO: 12615 - RNA, 1617 nt, Artificial Sequence
  derived and/or modified sequence opt1 from VP1__Norovirus_and/or_Norovirus-like__KJ790198
augcgcauggccagcgacgacgccaaguccgcgcccagcgaccuggagggcgccgggcucgugccggccaccgccgcgccccugcccgucgcccccguggccggcgcccaggccgcggagccguucgccgggcagaucaacgugaucgaccccuggaucuacaccaacuucguccaggcccccacgggcgaguucaccgugagcccccggaacaccccgggggaggugcuggucaaccucgagaucggccccaaccugaaccccuaccugcagcaccucgcccagauguacaacggcuacgccgggggcguggaggugcaggucauccuggcggggaacgccuucaccgccggcaagcugcucugcgcccuggugcccccgggguuccccacguccuccaucacccccgcccagcugaccaugcucccccacaccaucaucgacgugcgcacgaccgacccggucguggugcccaugcccgacguccggcgcacccuguggcacgaggugcggagcaccacggagccccugaugcgccucgugaucaugcuguacaccccgaugcgggcgaacuccggcagcgacgaggccuucgucguguccggccgcgugcugagccggcccgcccccgacuucaacuucuucuaccucgugcccccgcgcguggaggacaccguggagcccuucucccugcccgaccugcgggucgacgagaugagcuccagccgcuggcagaaccccguggucaugcuccaggccgacccgaaccagaacaucgccgcgcacuggcagaacgggcggugcaccaucaacggcgagcugcuggggacgacgccccgcaaccaguccuggcuccugcggaugcgcggcagcgugcuggccgcccccggcgggcagaaggccgugaccgucaacguggaccucaccgagccggacggccaggccuucuccgugcugagcgggaaccccggccccgaggggguccccgacuuccaggcgaucuacaacgugcggauguccaccgccagcaccaccgccggccacaccguggccacgaacggcuacaucgagcagagcggguacaccccggcgcugggcacccucgucauccaggggguggaccugucccaggugcccgcccugggcagcgaggucaccaugcaggucguguccaucgaccucaaccacaacauggaccccacgcgccugcccgacuacaacggggccggcuucgacggcagcgucgcccuggccccgccccucgugccgccccugcccggggaggugcugcuccgguucaccacccugcccaucaccacgucccgcggcagcuccgucagcgcgacccuggacugcgcccuccccgccgaguggaucaccugguuccuggugcacaacuucgugccccagggggacgccgcccugcuccgguaccgcaaccgcggcaccgggcagauccuguucgagugcaagcuguacaaggagggcuuccucgcggucgccggcguguccacgcggaccguguucccgaccagcggggucuucgaguucguguccugggugcccgucuucuaccagcugacccccgugggcagcuccggggcccgcaagcgguga

SEQ ID NO: 12616 - RNA, 1617 nt, Artificial Sequence
  derived and/or modified sequence opt1 from VP1__Norovirus_and/or_Norovirus-like__KF306212
augaugauggccagcaaggacgcgccccaguccgccgacggcgccagcggggccggccagcuggugccggaggucaacaccgccgacccccuccccauggagcccguggccgggccgaccacggcgguggccaccgccggccaggucaacaugaucgaccccuggaucgugaacaacuucgugcagagcccccagggggaguucaccaucucccccaacaacaccccgggcgacauccuguucgaccugcagcucggcccccaccugaaccccuuccugucccaccucagccagauguacaacgggugggucggcaacaugcgcgugcggauccugcuggccgggaacgcguucuccgccggcaagaucaucgugugcuucgugcccccgggguucacgagcuccagccucaccaucgcccaggccacccuguucccccacgucaucgccgacgugcgcacccuggagcccaucgagaugccccucgaggacguccggaacgugcuguaccacacgaacgacaaccagccgaccaugcgccuggugugcaugcucuacacgccccugcggaccggcggcggguccggcagcuccgacagcuucgucguggcggggcgcgugcugaccgcccccuccagcgacuucuccuuccucuuccuggugcccccgaccaucgagcagaagacccgggccuucaccguccccaacaucccccugcagacgcucagcaacucccgcuuccccagccugauccagggcaugauccugagcccggacgccucccaggugguccaguuccagaacggccggugccucaucgacgggcagcugcugggcaccacccccgccaccagcgggcagcuguuccgcgugcggggcaagaucaaccagggggcgcgcacgcucaaccugaccgagguggacggcaagcccuucauggccuucgacucccccgccccggucggcuuccccgacuucgggaagugcgacuggcacaugcggaucagcaagacccccaacaacaccuccagcggcgacccgaugcgcuccgugagcguccagacgaacgugcagggguucgugccccaccucggcuccauccaguucgacgaggucuucaaccaccccaccggggacuacaucggcaccaucgaguggaucagccagcccuccaccccgcccggcacggacaucaaccugugggagauccccgacuacgggagcucccugagccaggccgccaaccucgcgcccccgguguucccgcccggcuucggggaggcccugguguacuucgucuccgccuuccccggccccaacaaccggagcgcccccaacgacgugcccugccugcucccccaggaguacaucacccacuucguguccgagcaggccccgaccaugggggacgcggcccugcugcacuacgucgaccccgacaccaaccgcaaccucggcgaguucaagcuguaccccggcggguaccugacgugcgugcccaacggcgugggggccggcccgcagcagcucccccugaacggcgucuuccuguucgugagcugggugucccgguucuaccagcucaagcccgucgggaccgccagcaccgcgcgcuga

SEQ ID NO: 12617 - RNA, 1617 nt, Artificial Sequence
  derived and/or modified sequence opt1 from VP1__Norovirus_and/or_Norovirus-like__KM461694
augaagauggccagcaacgacgccgcgcccuccaacgacggcgccgccaaccuggugcccgaggccaacaacgaggucauggcccucgagcccguggugggggcgagcaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucucccaccugagccgcauguacaacggcuacgcgggcgggaugcagguccagguggugcuggccggcaacgccuucaccgccgggaagaucaucuucgccgcggugccgccccacuuccccguggacaacaucuccgccgcccagaucacgaugugcccccacgucaucguggacgugcggcagcucgagcccguccugcugccccuccccgacauccgcaaccgguucuuccacuacaaccaggaggacaccccgcgcaugcggcugguggccaugcuguacacgccccuccgcgccaacagcggcgaggacguguucaccgucuccugccgggugcugacccgccccgcgcccgacuucgaguucaccuuccuggugccgcccaccgucgagagcaagaccaagcccuucacgcuccccauccugacccugggggagcucuccaacagccgguucccggccgccaucgacaugcuguacaccgaccccaacgaguccaucguggugcagccccagaacggccgcugcacccuggacggcacgcuccaggggaccacccagcugguccccacccagaucugcgccuuccggggcacgcugaucagccagaacgcccgcgcggccgaccucaccgacuccccgcagcgggcccgcaaccacccccugcacgugcaggucaagaaccuggacgggacccaguacgaccccaccgacgacaucccggccgugcucggcgccaucgacuucaagggcacgguguucggggucgcgagccagcgggacguguccggcacccaggagcaggggcacuacgccacccgcgcccacgaggcccacaucgacaccacggaccccaaguacgcgcccaagcugggcaccauccugaucaagagcgaguccaccgacuucaccacgaaccagcccauccgguucaccccgguggggaugggcgacaacaacuggcgccagugggagcuccccgacuacagcggcagccugacccugaacaugaaccucgcccccgccgucucccccagcuucccgggggagcggauccuguucuuccgcuccaucgugcccagcgccggcggguacggcuccggguacaucgacugccugaucccccaggagugggugcagcacuucuaccaggaggccgcgcccagccaguccgccgucgcccucgugcgcuacgugaacccggacaccggccggaacaucuucgaggccaagcugcaccgcgagggcuuccugacggucgccaacagcgggaacaaccccaucguggugccgcccaacggcuacuuccgguucgaggcgugggucaaccaguucuacacccucgccuga

SEQ ID NO: 12618 - RNA, 1614 nt, Artificial Sequence
  derived and/or modified sequence opt1 from VP1__Norovirus_and/or_Norovirus-like__AB039780
augaagauggccagcaacgacgccgcgcccuccaacgacggcgccgccgggcuggugccggagaucaaccacgaggucauggccaucgagcccguggccggcgcgagccucgccgcccccguggucgggcagcugaacaucaucgaccccuggauccgcaacaacuucgugcaggccccggcgggcgaguucaccgugagcccccggaacgcccccggggaguuccugcucgaccuggagcugggccccgagcucaacccguaccuggcccaccuggcccgcauguacaacggccacgccgggggcauggagguccagaucgugcucgcggggaacgccuucaccgccggcaagauccuguucgccgugaucccgcccggguuccccuacgagaaccugucccccgcccagcucacgaugugcccccacgucgugguggacguccggcagcuggagcccauccugcuccccaugccggacauccgcaacaccuucuuccacuacaaccaguccaacggccccaagcugcggcugguggcgaugcucuacacgccccugcgcgccaacaacgccggcgaggacguguucaccgucagcugccgggugcugacccgccccuccccggacuucgaguucaacuuccucgugccgcccagcgucgaguccaagaccaaggccuucacccugcccauccugaagaucagcgagaugaccaacucccgguuccccauccccguggaccagauguacacgagccgcaacgagaacaucgugguccagccccagaacgggcgggugacccucgacggcgagcugcaggggaccaccacgcugcagcccguguccaucugcggcuuccgcggcacccuccagacccggcuggccgaccagccgaacuacaccuaccagguccaccuggagaaccucgacgggagccccguggaccccacggacgaggucccggcgccccugggcacccccgacuuccaggcccagcuguucggggugaucucccagcgcagcuccgacaacgccacccgggcccacgaggcccgcgugaacaccaacgaccccacguucgcgccgcagaucgcccagguccgguucaagagccccuccaacgacuucuucgacaacgagcccaucaaguucacccccgugggcaucagcguggacagccagaacuccuacaaccaguggcuccugccgcgcuacgggggccaccugaccaacaacacccaccucgcccccagcgucucccccauguuccccggcgagcagauccuguucuuccggagcuucaugccgggggccuccggccacacggacggggcgaucgacugccugcucccccaggaguggguggcccacuucuaccaggaggccgccaccgcccagaccgacguggcgcugauccgcuucgucaaccccgacaccggccgggugcuguucgaggggaagcuccacaagcagggcuucaucacgaucagcaacuccggcgaccaccccaucgugaugccggccaacggguacuuccgcuucgaggccugggucaaccaguucuacagccuggcccccgugggcaccggguccggccgccggcgcauccaguga

SEQ ID NO: 12619 - RNA, 1614 nt, Artificial Sequence
  derived and/or modified sequence opt1 from VP1__Norovirus_and/or_Norovirus-like__AY038599
augaagauggccagcaacgacgccgcgcccuccagcgacggcgccgccgggguggucccggagaucaaccacgaggugauggccaucgagcccguggccggcgcguccaucgccgcccccgucguggggcagcagaacaucaucgaccccuggauccgcaacaacuucgugcaggccccggcgggcgaguucaccgucagcccccggaacgcccccggggaguuccugcucgaccuggagcugggccccgaccucaacccguaccuggcccaccuggcccgcauguacaacggccacgccgggggcauggaggugcagaucgugcucgcggggaacgccuucaccgccggcaagauccuguucgccgucaucccgcccggguuccccuacgagaaccugugccccgcccagcucacgaugugcccccacgugguggucgacgugcggcagcuggagcccgugaugcugcccaugccggacauccgcaacaccuucuuccacuacaaccaggacggcggccccaagcuccggcugaucgcgaugcuguacacgccccuccgcgccaacaacuccggggacgacgucuucaccgugagcugccgggugcugacccgccccgccccggacuucgaguucaccuuccuggucccgcccuccaucgagagcaagaccaaggccuucaccauccccgugcucaagaucuccgagaugacgaacagccgguuccccgugcccgucgaccagauguacaccucccgcagcgagggcaucguggugcagccccagaacgggcgggccaccaucgacggcgagcugcugggcaccacgcucgucucccccgugagcgucugcaacuucaaggggaaccugcaggcggaggugccgggccagcaccagcuguaccagcuccagcugaccaaccuggacgggucccccaucgaccccaccgacgacaccccgggcccccucgggugccccgacuucacgggccugcuguacggcguggccagccagcgcgggcccggcgacgccacccgggcccacgaggcccgcaucgacaccggguccgacaccuucgcgccgaagaucggccagguccgguucuacagcacguccagcgacuucgagaccaaccagcccacccacuucacccccaucgggaucuacaucgagggcaacagcuccgacuucaaccaguggcagcucccccgcuacggcgggcaccuggccaacaacaaccaccuggccccggccgugagcccccucuuccccggcgagcagauccuguucuuccgguccuucauccccggggcgagcggccacacgaacggggagauggacugccugcucccgcaggaguucgugcagcacuucuaccaggaggccgccaccgcccgcuccgaggucgcccugcugcgguucgugaaccccgacaccggccgcgcccucuucgagagcaagcugcacaagcagggcuucaugaccaucgcguccagcggggaccaccccaucaucaugcccacgaacggcuacuuccgguucgaggccugggugaaccaguucuacucccuggccccggucgggaccggcagcggccgccgccggauccaguga

SEQ ID NO: 12620 - RNA, 1614 nt, Artificial Sequence
  derived and/or modified sequence opt1 from VP1__Norovirus_and/or_Norovirus-like__AY054299
augaagauggccagcaacgacgccgcgcccuccagcgacggcgccgccgggcuggugccggagaucaaccacgaggucauggccaucgagcccguggccggcgcguccaucgccgcccccguggucgggcagcagaacaucaucgaccccuggauccgcaacaacuucgugcaggccccggcgggcgaguucaccgugagcccccggaacgcccccggggaguuccuccuggaccuggagcucggccccgaccugaacccguaccuggcccaccucgcccgcauguacaacggccacgccgggggcauggagguccagaucgugcuggcggggaacgccuucaccgccggcaagauccuguucgccgugaucccgcccggguuccccuacgagaaccucucccccgcccagcugacgaugugcccccacgucgugguggacguccggcagcuggagcccgugaugcuccccaugccggacauccgcaacaccuucuuccacuacaaccaggacggcggcccccggcugcgccugaucgcgaugcucuacacgccccugcgggccaacaacagcggggacgacguguucaccgucuccugccgcgugcugacccggcccgccccggacuucgaguucaccuuccucgugccgcccagcaucgaguccaagaccaaggccuucaccauccccguccugaagaucagcgagaugacgaacucccgcuuccccgugcccguggaccagauguacaccagccgguccgagggcaucgucgugcagccccagaacgggcgcgccaccaucgacggcgagcugcucggcaccacgcuggugagccccgucuccgugugcaacuucaaggggaaccugcaggcggaggucccgggcgagcaccagcucuaccagcugcagcugaccaaccucgacgggagccccaucgaccccaccgacgacaccccgggcccccuggggugccccgacuucacgggccugcucuacggcguggccucccagcgggggcccggcgacgccacccgcgcccacgaggcccggaucgacaccgggagcgacaccuacgcgccgaagaucggccaggugcgcuucuacuccacgagcagcaacuucgagcggaaccagcccacccacuucacccccaucgggaucuacaucgagggcaacuccagcgacuucaaccaguggcagcugccccgcuacggcgggcaccuggccaacaacaaccaccucgccccggccgucagcccccuguuccccggcgagcagauccuguucuuccgguccuucauccccggggcguccggccacaccaacggggagauggacugccuccugccgcaggaguucgugcagcacuucuaccaggaggccgccacggcccagagcgagguggcccugcuccgcuucgucaaccccgacaccggccgggugcuguucgaguccaagcugcacaagcagggcuucaugaccaucgcgagcuccggggaccaccccaucaucaugcccaccaacggcuacuuccgcuucgaggccugggugaaccaguucuacagccucgccccggucgggacgggcuccggccgccggcgcauccaguga

SEQ ID NO: 12621 - RNA, 1614 nt, Artificial Sequence
  derived and/or modified sequence opt1 from VP1__Norovirus_and/or_Norovirus-like__AF195848
augaagauggccagcaacgacgccgcgcccuccaacgacggcgccgccgggcuggugccggagaucaaccacgaggucauggccaucgagcccguggccggcgcgagccucgccgcccccguggucgggcagcugaacaucaucgaccccuggauccgcaacaacuucgugcaggccccggcgggcgaguucaccgugagcccccggaacgcccccggggaguuccugcucgaccuggagcugggccccgagcucaacccguaccuggcccaccuggcccgcauguacaacggccacgccgggggcauggagguccagaucgugcucgcggggaacgccuucaccgccggcaagauccuguucgccgugaucccgcccggguuccccuacgagaaccugucccccgcccagcucacgaugugcccccacgucgugguggacguccggcagcuggagcccauccugcuccccaugccggacauccgcaacaccuucuuccacuacaaccaguccaacggccccaagcggcgccugguggcgaugcuguacacgccccuccgggccaacaacgccggcgacgacguguucaccgucagcugccgcgugcugacccggcccuccccggacuucgaguucaacuuccuggugccgcccagcgucgaguccaagaccaaggccuucacccuccccgugcugaagaucagcgagaugaccaacucccgcuuccccauccccguggaccagauguacacgagccggaacgagaacaucgucgugcagccccagaacgggcgcgugacccuggacggcgagcuccaggggaccaccacgcugcagcccgucuccaucugcggcuuccggggcacccugcagacccgccucgccgaccagccgaacuacaccuaccaggugcaccuggagaaccuggacgggagccccgucgaccccacggacgaggugccggcgccccucggcacccccgacuuccaggcccagcuguucggggugaucucccagcggagcuccgacaacgccacccgcgcccacgaggcccgggucaacaccaacgaccccacguucgcgccgcagaucgcccaggugcgcuucaagagccccuccaccgacuucagcgacaacgagcccaucaaguucacccccgugggcaucagcgucgacucccagaacagcuacaaccaguggcugcucccgcgguacgggggccaccugaccaacaacacgcaccuggcccccuccgugagccccauguuccccggcgagcagauccucuucuuccgcuccuucaugccgggggccggcggguucaccgacggcgcgaucgacugccugcugccccaggaguggguggcccacuucuaccaggaggccgccaccgcccagaccgacgucgcgcucauccgguucgugaaccccgacacggggcgcgugcuguucgagggcaagcugcacaagcagggcuucaucaccaucagcaacuccggggaccaccccaucgucaugccggccaacggcuacuuccgcuucgaggccugggugaagcaguucuacagccucgcccccguggggaccggcuccgggcggcgccggguccaguga

SEQ ID NO: 12622 - RNA, 1614 nt, Artificial Sequence
  derived and/or modified sequence opt1 from VP1__Norovirus_and/or_Norovirus-like__AB303927
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcuccaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccgugccccuggagaagcucuacaccggccccagcuccgccuucgucgugcagccgcagaacgggcgcugcacgaccgacggcguccugcuggggaccacccagcucagcgccgugaacaucugcacguuccggggcgacgugacccacaucgccggcucccacgacuacaccaugaaccuggccagccagaacuggaacaacuacgaccccaccgaggagauccccgcgccgcuggggacgcccgacuucgucggcaagauccagggggugcucacccagaccacccgcgaggacggcagcacgcgggcccacaaggccaccguguccaccgggagcguccacuucacccccaagcugggcuccgugcaguacacgaccgacaccaacaacgacuuccagaccggccagaacacgaaguucacccccgugggggucauccaggacggcagcaaccaccagaacgagccgcagcagugggugcugcccaacuacuccgggcgcaccggccacaacgugcaccucgcccccgccgucgcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacguggcgcuccugcgcuucgucaaccccgacaccgggcgggugcuguucgagugcaagcuccacaaguccggcuacgugaccgucgcccacaccgggccccacgaccuggugaucccgcccaacggcuacuuccgcuucgacagcugggugaaccaguucuacacccuggcccccauggggaacggcgccggccggcgccgguga

SEQ ID NO: 12623 - RNA, 1614 nt, Artificial Sequence
  derived and/or modified sequence opt1 from VP1__Norovirus_and/or_Norovirus-like__AY038600
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaaggugaucuucgccgccgugccgcccaacuucccgaccgaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggccaacaacgcgggcgacgacguguucaccgucuccugccgcgugcugacccggcccagcccggacuucgacuucaucuuccucgugccgcccaccgucgagucccgcacgaagcccuucaccgugcccauccugaccguggaggagaugagcaacucccgguuccccaucccccuggagaagcucuacaccggccccagcuccgccuucgucgugcagccgcagaacgggcgcugcacgaccgacggcguccugcuggggaccacccagcucagcgccgugaacaucugcacguuccggggcgacgugacccacaucgccggcucccacgacuacaucaugaaccuggccagccagaacuggaacaacuacgaccccaccgaggagauccccgcgccgcuggggacccccgacuucgucggcaagauccaggggaugcucacgcagaccacccgcgaggacggcagcacccgggcccacaaggccacgguguccaccgggagcgugcacuucacccccaagcugggcuccguccaguacaccacggacaccaacaacgaccugcagaccggccagaacaccaaguucacgcccgugggggugauccaggacggcaacaaccaccagaacgagccgcagcaguggguccuccccaacuacagcgggcgcaccggccacaacgugcaccuggcccccgccguggcgcccaccuucccgggggagcagcuccuguucuuccgguccaccaugcccggcugcagcggcuaccccaacaugaaccuggacugccugcucccccaggaguggguccagcacuucuaccaggaggccgccccggcccaguccgacguggcgcugcugcgcuucgugaaccccgacacggggcggguccucuucgagugcaagcugcacaagagcggcuacgugaccguggcccacaccgggccccacgaccuggucaucccgcccaacggcuacuuccgcuucgacuccugggugaaccaguucuacacccucgcccccauggggaacggcgccggccggcgccgguga

SEQ ID NO: 12624 - RNA, 1614 nt, Artificial Sequence
  derived and/or modified sequence opt1 from VP1__Norovirus_and/or_Norovirus-like__AF080554
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggguccucacccagaccaccaaggaggacggcagcacgcgcgcccacaaggccaccgugagcaccggguccgugcacuucacccccaagcugggcagcguccaguacacgaccgacaccaacaacgacuuccagaccggccagaacacgaaguucacccccgugggggugauccaggacggcaacaaccaccagaacgagccgcagcaguggguccugcccaacuacuccgggcggaccggccacaacgugcaccucgcccccgccguggcgcccaccuucccgggggagcagcugcuguucuuccgcagcacgaugcccggcugcuccggcuaccccaacaugaaccucgacugccugcugccccaggaguggguccagcacuucuaccaggaggccgccccggcccagagcgacguggcgcuccugcgguucgugaaccccgacaccgggcgcguccuguucgagugcaagcuccacaaguccggcuacgugaccguggcccacaccgggccccacgaccuggucaucccgcccaacggcuacuuccgguucgacagcugggugaaccaguucuacacccuggcccccauggggaacggcgccggccgccggcgcuga

SEQ ID NO: 12625 - RNA, 1614 nt, Artificial Sequence
  derived and/or modified sequence opt1 from VP1__Norovirus_and/or_Norovirus-like__AB294778
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccgugccccuggagaagcucuacaccggccccuccagcgccuucgucgugcagccgcagaacgggcgcugcacgaccgacggcguccugcuggggaccacccagcucuccgccgugaacaucugcacguuccggggcgacgugacccacaucgccggcagccacgacuacaccaugaaccuggccucccagaacuggaacaacuacgaccccaccgaggagauccccgcgccgcuggggacgcccgacuucgucggcaagauccagggggugcucacccagaccacccgcgaggacggcagcacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcuccaaccaccagaacgagccgcagcagugggugcugcccaacuacagcgggcgcaccggccacaacgugcaccucgcccccgccgucgcgcccaccuucccgggggagcagcugcuguucuuccgguccacgaugcccggcugcagcggcuaccccaacaugaaccucgacugccugcugccccaggagugggugcagcacuucuaccaggaggccgccccggcccaguccgacguggcgcuccugcgcuucgucaaccccgacaccgggcgggugcuguucgagugcaagcuccacaagagcggcuacgugaccgucgcccacaccgggccccacgaccuggugaucccgcccaacggcuacuuccgcuucgacuccugggugaaccaguucuacacccuggcccccauggggaacggcgccggccggcgccgguga

SEQ ID NO: 12626 - RNA, 1614 nt, Artificial Sequence
  derived and/or modified sequence opt1 from VP1__Norovirus_and/or_Norovirus-like__AB303922
augaagauggccagcaacgacgccacccccuccgacggcagcaccgcgaaccuggugccggaggucaacaacgaggugauggcccucgagcccguggucggggccgccaucgccgcgcccguggccggccagcagaacgugaucgaccccuggauccgcuccaacuucguccaggcccccgggggcgaguucacggugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucaccgcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcaccaagcccuucaccguccccauccugaccguggaggagaugagcaacucccgguuccccaucccccuggagaagcucuacacgggccccagcuccgccuucgugguccagccgcagaacgggcgcugcaccaccgacggcgugcugcuggggaccacgcagcucagcgccgucaacaucugcaccuuccggggcgacgugacccacaucgccggcucccacgacuacaccaugaaccuggccagccagaacuggaacaacuacgaccccacggaggagauccccgcgccgcuggggacccccgacuucgugggcaagauccaggggguccucacccagaccacgcgcggcgacgggagcacccgggcccacaaggccaccguguccaccggcagcgugcacuucacgcccaagcugggcuccguccaguacaccaccgacaccaacaacgacuuccagacggggcagaacaccaaguucacccccgugggcgugauccaggacggggacaaccaccagaacgagccgcagcaguggguccugcccaacuacagcggccgcaccgggcacaacgugcaccucgcccccgccguggcgcccacguucccgggcgagcagcugcuguucuuccgguccaccaugcccggcugcagcggguaccccaacaugaaccucgacugccugcugccccaggaguggguccagcacuucuaccaggaggccgccccggcccaguccgacguggcgcuccugcgcuucgugaaccccgacaccggccggguccuguucgagugcaagcuccacaagagcggguacgugaccguggcccacaccggcccccacgaccuggucaucccgcccaacggguacuuccgcuucgacuccugggugaaccaguucuacacgcuggcccccaugggcaacggcgccgggcggcgccgguga

SEQ ID NO: 12627 - RNA, 1614 nt, Artificial Sequence
  derived and/or modified sequence opt1 from VP1__Norovirus_and/or_Norovirus-like__AY532128
augaagauggccagcaacgacgccaaccccuccgacggcagcaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggcgggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggccaacaacgcgggcgacgacgucuucaccgugagcugccgcgugcugacccggcccuccccggacuucgacuucaucuuccucgucccgcccaccguggagagccgcacgaagcccuucaccgugcccauccugaccgucgaggagauguccaacagccgguuccccaucccccuggagaagcucuacaccggccccuccagcgccuucguggugcagccgcagaacgggcgcugcacgaccgacggcguccugcuggggaccacccagcucuccgccgugaacaucugcacguuccggggcgacgucacccacaucgccggcagccacgacuacaccaugaaccuggccucccagaacuggaacaacuacgaccccaccgaggagauccccgcgccgcuggggacgcccgacuucgugggcaagauccaggggauccucacccagaccacccgcgaggacggcagcacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcaacaaccaccagaacgagccgcagcagugggugcugcccuccuacagcgggcgcaccggccacaacgugcaccucgcccccgccgucgcgcccaccuucccgggggagcagcugcuguucuuccgguccacgaugcccggcugcagcggcuaccccaacaugaaccucgacugccugcugccccaggagugggugcagcacuucuaccaggaggccgccccggcccaguccgacguggcgcuccugcgcuucgucaaccccgacaccgggcgggugcuguucgagugcaagcuccacaagagcggcuacgugaccgucgcccacaccgggccccacgaccuggugaucccgcccaacggcuacuuccgcuucgacuccugggugaaccaguucuacacccuggcccccauggggaacggcgccggccggcgccgguga

SEQ ID NO: 12628 - RNA, 1614 nt, Artificial Sequence
  derived and/or modified sequence opt1 from VP1__Norovirus_and/or_Norovirus-like__AY532113
augaagauggccagcaacgacgccaaccccuccgacggcagcaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggcgggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggccaacaacgcgggcgacgacgucuucaccgugagcugccgcgugcugacccggcccuccccggacuucgacuucaucuuccucgucccgcccaccguggagagccgcacgaagcccuucaccgugcccauccugaccgucgaggagauguccaacagccgguuccccaucccccuggagaagcucuacaccggccccuccagcgccuucguggugcagccgcagaacgggcgcugcacgaccgacggcguccugcuggggaccacccagcucuccgccgugaacaucugcacguuccggggcgacgucacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcaacaaccaccagaacgagccgcaccagugggugcugcccaacuacuccgggcgcaccggccacaacgugcaccucgcccccgccgucgcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacguggcgcuccugcgcuucgucaaccccgacaccgggcgggugcuguucgagugcaagcuccacaaguccggcuacgugaccgucgcccacaccgggccccacgaccuggugaucccgcccaacggcuacuuccgcuucgacagcugggugaaccaguucuacacccuggcccccauggggaacggcgccggccggcgccgguga

SEQ ID NO: 12629 - RNA, 1614 nt, Artificial Sequence
  derived and/or modified sequence opt1 from VP1__Norovirus_and/or_Norovirus-like__EU078406
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaagaucaucuucgccgccgugccgcccaacuucccgacggaggggcugagccccucccaggugaccauguucccccacgugaucgucgacgugcggcagcuggagcccgugcucaucccgcugcccgacguccgcaacaacuucuaccacuacaaccaggcccacgaccccaccaucaagcugaucgccaugcucuacacgccccugcgggcgaacaacgccggcgacgacguguucaccgugagcugccgcguccugacccggccgucccccgacuucgacuucaucuuccucgugccgcccaccguggagagccgcaccaagcccuucacgguccccauccugaccguggaggagauguccaacagccgguuccccaucccccuggagaagcucuacaccggcccguccagcgacuucgugguccagccccagaacgggcgcugcaccacggacggcgugcugcuggggaccacccagcucuccgccgucaacaucugcaacuucaagggcgacgugacccacaucgccggcagccgggacuaccgcaugaaccuggugucccagaacuggaacaacuacgaccccacggaggagaucccggcgccccuggggacccccgacuuccagggcaagauccaggggcuccugacccagaccacgggcgccgacgggagcacccgggcccacaaggccaccgucagcaccggcgccgccaacuucacgcccaagcugggcuccgugcaguucaccaccgacaccgacaacgacuuccagacggggcagaacaccaaguucaccccggugggcgucauccaggacgggagccaccaccagaacgagccccagcagugggugcuccccaacuacuccggccgcaccgugcacaacguccaccuggcgcccgccguggccccgacguuccccggggagcagcuccuguucuuccggagcaccaugcccggcugcuccggcuaccccaacaugaaccuggacugccugcucccgcaggagugggugaugcacuucuaccaggaggccgcgcccgcccagagcgacgucgcccugcugcgcuucgugaaccccgacaccgggcggguccucuucgagugcaagcugcacaaggccggcuacaucaccguggcccacacggggcagcacgaccuggugaucccgcccaacggcuacuuccgcuucgacuccugggugaaccaguucuacacccucgcgcccauggggaacggcgccggccggcgccgguga

SEQ ID NO: 12630 - RNA, 1614 nt, Artificial Sequence
  derived and/or modified sequence opt1 from VP1__Norovirus_and/or_Norovirus-like__AF472623
augaagauggccagcaacgacgccaaccccuccgacggcagcaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggcgggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggccaacaacgcgggcgacgacgucuucaccgugagcugccgcgugcugacccggcccuccccggacuucgacuucaucuuccucgucccgcccaccguggagagccgcacgaagcccuucaccgugcccauccugaccgucgaggagauguccaacagccgguuccccaucccccuggagaagcucuacaccggccccuccagcgccuucguggugcagccgcagaacgggcgcugcacgaccgacggcguccugcuggggaccacccagcucuccgccgugaacaucugcacguuccggggcgacgucacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcaacaaccaccagaacgagccgcagcagugggugcugcccaacuacuccgggcgcaccggccacaacgugcaccucgcccccgccgucgcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacguggcgcuccugcgcuucgucaaccccgacaccgggcgggugcuguucgagugcaagcuccacaaguccggcuacgugaccgucgcccacaccgggccccacgaccuggugaucccgcccaacggcuacuuccgcuucgacagcugggugaaccaguucuacacccuggcccccauggggaacggcgccggccggcgccgguga

SEQ ID NO: 12631 - RNA, 1614 nt, Artificial Sequence
  derived and/or modified sequence opt1 from VP1__Norovirus_and/or_Norovirus-like__AF427114
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgccagcugccgcgugcugacccggcccuccccggacuucgacuucaucuuccucgucccgcccaccguggagagccgcacgaagcccuucaccgugcccauccugaccgucgaggagauguccaacagccgguuccccaucccccuggagaagcucuacaccggccccuccagcgccuucguggugcagccgcagaacgggcgcugcacgaccgacggcguccugcuggggaccacccagcucuccgccgugaacaucugcacguuccggggcgacgucacccacaucgccggcagccacgacuacaccaugaaccuggcgucccagaacuggaacaacuacgaccccaccgaggagauccccgccccgcuggggacgcccgacuucgugggcaagauccagggggugcucacccagaccacccgcgaggacggcagcacgcgggcccacaaggccaccgucagcaccggguccgugcacuucacccccaagcugggcagcgugcaguacacgaccgacaccaacaacgacuuccagaccggccagaacacgaaguucacccccgucggggugauccaggacggcuccaaccaccagaacgagccgcagcagugggugcugcccaacuacagcgggcgcaccggccacaacguccaccucgcccccgcgguggcccccaccuucccgggggagcagcugcuguucuuccgguccacgaugcccggcugcagcggcuaccccaacaugaaccucgacugccugcugccccaggagugggugcagcacuucuaccaggaggccgccccggcgcaguccgacgucgcccuccugcgcuucgugaaccccgacaccgggcgggugcuguucgagugcaagcuccacaagagcggcuacgucaccguggcccacaccgggccccacgaccuggugaucccgcccaacggcuacuuccgcuucgacuccugggucaaccaguucuacacccuggcccccauggggaacggcgccggccggcgccgguga

SEQ ID NO: 12632 - RNA, 1614 nt, Artificial Sequence
  derived and/or modified sequence opt1 from VP1__Norovirus_and/or_Norovirus-like__AY532114
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucagcaccggguccgugcacuucacccccaagcugggcagcgugcaguacacgaccgacaccaacaacgacuuccagaccggccagaacacgaaguucacccccgucggggugauccaggacggcaacaaccaccagaacgagccgcaccagugggugcugcccaacuacuccgggcgcaccggccacaacguccaccucgcccccgccguggcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacgucgcgcuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcugggucaaccaguucuacacccuggcccccauggggaacggcgccggccggcgccgguga

SEQ ID NO: 12633 - RNA, 1614 nt, Artificial Sequence
  derived and/or modified sequence opt1 from VP1__Norovirus_and/or_Norovirus-like__KF806505
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucaccgggaccuccgaguacgccaugaaccuggccagccagaacuggaacaacuacgacccgaccgaggagauccccgcgccccucggcgcccccgacuucguggggaagauccgcggcaugcugacgcagaccacccggcgcgacggguccacccggggccaccgcgccacgcugagcaccggcagcgcccacuucaccccgaagcucggguccauccgguucagcaccgacacgaacaacgacuucgaggccggccagaacaccaaguucacccccgucgggguguuccaggagggcgacaaccaccagaacgagccccagcagugggugcugcccaacuacuccggggcgaccgcccacaacguccaccuggccccggccguggcgcccgccuuccccggcgagcagcuccuguucuuccgcagcacgaugcccggcugcgggggcuacccgaacaugaaccuggacugccuccugccccaggagugggugcagcacuucuaccaggaggccgcccccgcccaguccgacgucgcgcugcuccgguucgugaaccccgacaccagccgcgugcuguucgagugcaagcugcacaaguccggguacgucaccguggcccacaccggccagcacgaccucgugaucccgcccaacggguacuuccgguucgacagcugggucaaccaguucuacacgcuggcccccaugggcaacggcaccgggcgccgccgguga

SEQ ID NO: 12634 - RNA, 1614 nt, Artificial Sequence
  derived and/or modified sequence opt1 from VP1__Norovirus_and/or_Norovirus-like__JQ478407
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacaucacccacaucgccggcucccacgacuacaccaugaaccuggccagccagaacuggagcaacuacgaccccaccgaggagauccccgcgccgcuggggacgcccgacuucgugggcaagauccaggggaugcucacccagaccacccgcgaggacggcuccacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcgggaaccaccagaacgagccgcagcagugggugcugcccaacuacuccggccgcaccgggcacaacgugcaccucgcccccgccgucgcgcccaccuucccgggcgagcagcugcuguucuuccggagcacgaugcccggcugcuccggguaccccaacaugaaccucgacugccugcugccccaggagugggugcagcacuucuaccaggaggccgccccggcccagagcgacguggcgcuccugcgcuucgucaaccccgacaccggccgggugcuguucgagugcaagcuccacaaguccggguacgugaccgucgcccacaccggcccccacgaccuggugaucccgcccaacggguacuuccgcuucgacagcugggugaaccaguucuacacccuggcccccaugggcaacggcgccgggcggcgccgguga

SEQ ID NO: 12635 - RNA, 1614 nt, Artificial Sequence
  derived and/or modified sequence opt1 from VP1__Norovirus_and/or_Norovirus-like__AB303923
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucagcaccggguccgugcacuucacccccaagcugggcagcgugcaguacacgaccgacaccaacaacgacuuccagaccggccagaacacgaaguucacccccgucggggugauccaggacggcaacaaccaccagaacgagccgcagcagugggugcugcccaacuacuccgggcgcaccggccacaacguccaccucgcccccgccguggcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacgucgcgcuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcugggucaaccaguucuacacccuggcccccauggggaacggcgccggccggcgccgguga

SEQ ID NO: 12636 - RNA, 1614 nt, Artificial Sequence
  derived and/or modified sequence opt1 from VP1__Norovirus_and/or_Norovirus-like__AF427120
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucaucgugcagccgcagaacgggcgcugcacgaccgacggcguccugcuggggaccacccagcucuccgccgugaacaucugcacguuccggggcgacgucacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcaacaaccaccagaacgagccgcagcagugggugcugcccaacuacuccgggcgcaccggccacaacgugcaccucgcccccgccgucgcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacguggcgcuccugcgcuucgucaaccccgacaccgggcgggugcuguucgagugcaagcuccacaaguccggcuacgugaccgucgcccacaccgggccccacgaccuggugaucccgcccaacggcuacuuccgcuucgacagcugggugaaccaguucuacacccuggcccccauggggaacggcgccggccggcgccgguga

SEQ ID NO: 12637 - RNA, 1614 nt, Artificial Sequence
  derived and/or modified sequence opt1 from VP1__Norovirus_and/or_Norovirus-like__AY532134
augaagauggccagcaacgacgccaaccccuccgacggcagcaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggcgggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggccaacaacgcgggcgacgacgucuucaccgugagcugccgcgugcugacccggcccuccccggacuucgacuucaucuuccucgucccgcccaccguggagagccgcaucaagcccuucacggugcccauccugaccgucgaggagauguccaacagccgguuccccaucccccuggagaagcucuacaccggccccuccagcgccuucguggugcagccgcagaacgggcgcugcaccacggacggcguccugcuggggaccacccagcucuccgccgugaacaucugcaccuuccggggcgacgucacgcacaucgccggcagccacgacuacaccaugaaccuggccucccagaacuggaacaacuacgaccccaccgaggagauccccgcgccgcuggggacccccgacuucgugggcaagauccagggggugcucacgcagaccacccgcgaggacggcagcacccgggcccacaaggccacggucagcaccggguccgugcacuucacccccaagcugggcagcgugcaguacaccacggacaccaacaacgacuuccagaccggccagaacaccaaguucacgcccgucggggugauccaggacggcaacaaccaccagaacgagccgcagcagugggugcugcccaacuacuccgggcgcgccggccacaacguccaccucgcccccgcgguggcccccaccuucccgggggagcagcugcuguucuuccggagcaccaugcccggcugcuccggcuaccccaacaugaaccucgacugccugcugccccaggagugggugcagcacuucuaccaggaggccgccccggcgcagagcgacgucgcccuccugcgcuucgugaaccccgacaccgggcgggugcuguucgagugcaagcuccacaaguccggcuacgucacgguggcccacaccgggccccacgaccuggugaucccgcccaacggcuacuuccgcuucgacagcugggucaaccaguucuacgcccuggcccccauggggaacggcgcgggccggcgccgguga

SEQ ID NO: 12638 - RNA, 1614 nt, Artificial Sequence
  derived and/or modified sequence opt1 from VP1__Norovirus_and/or_Norovirus-like__AY532116
augaagauggccagcaacgacgccaaccccuccgacggcagcaccgcgaaccuggugccggaggucaacaacgaggugauggcccucgagcccguggucggggccgccaucgccacccccguggcgggccagcagaacgugaucgaccccuggauccgcaacaacuucguccaggcccccgggggcgaguucacggugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgccggcgacgacguguucaccgugagcugccgcguccugacccggcccuccccggacuucgacuucaucuuccucgugccgcccaccguggagagccgcaccaagcccuucaccguccccauccugaccguggaggagauguccaacagccgguuccccaucccccuggagaagcucuacacgggccccuccagcgcguucgugguccagccgcagaacgggcgcugcaccaccgacggcgugcugcuggggaccacgcagcucuccgccgucaacaucugcaccuuccggggcgacgugacccacaucgccggcagccacgacuacaccaugaaccuggccucccagaacuggaacaacuacgaccccacggaggagauccccgccccgcuggggacccccgacuucgugggcaagauccaggggaugcucacccagaccacgcgcgaggacggcagcacccgggcgcacaaggccaccgucagcaccggguccgugcacuucacgcccaagcugggcagcgugcaguacaccaccgacaccaacaacgacuuccagacgggccagaacaccaaguucacccccgucggggugauccaggacggcaacaaccaccagaacgagccgcagcagugggugcugcccaacuacuccgggcgcaccggccacaacguccaccucgcccccgccguggcccccacguucccgggggagcagcugcuguucuuccggagcaccaugcccggcugcuccggcuaccccaacaugaaccucgacugccugcugccccaggagugggugcagcacuucuaccaggaggcggccccggcccagagcgacgucgcccuccugcgcuucgugaaccccgacaccgggcgggugcuguucgagugcaagcuccacaaguccggcuacgucaccguggcgcacaccgggccccacgaccuggugaucccgcccaacggcuacuuccgcuucgacagcugggucaaccaguucuacacgcuggcccccauggggaacggcgccggccggcgccgguga

SEQ ID NO: 12639 - RNA, 1614 nt, Artificial Sequence
  derived and/or modified sequence opt1 from VP1__Norovirus_and/or_Norovirus-like__AY532112
augaagauggccagcaacgacgccaaccccuccgacggcagcaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggcgggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggccaacaacgcgggcgacgacgucuucaccgugagcugccgcgugcugacccggcccuccccggacuucgacuucaucuuccucgucccgcccaccguggagagccgcacgaagcccuucaccgcccccauccugaccguggaggagauguccaacagccgguuccccaucccccuggagaagcucuacaccggccccuccagcgccuucgucgugcagccgcagaacgggcgcugcacgaccgacggcgugcugcuggggaccacccagcucuccgccgucaacaucugcacguuccggggcgacgugacccacaucgccggcagccacgacuacaccaugaaccuggcgucccagaacuggaacaacuacgaccccaccgaggagauccccgccccgcuggggacgcccgacuucgucggcaagauccaggggaugcucacccagaccacccgcgaggacggcagcacgcgggcccacaaggccaccgugagcaccggguccgugcacuucacccccaagcugggcagcguccaguacacgaccgacaccaacaacgacuuccagaccggccagaacacgaaguucacccccgugggggugauccaggacggcaacaaccaccagaacgagccgcagcaguggguccugcccaacuacuccgggcgcaccggccacaacgugcaccucgcccccgcgguggcccccaccuucccgggggagcagcugcuguucuuccggagcacgaugcccggcugcuccggcuaccccaacaugaaccucgacugccugcugccccaggaguggguccagcacuucuaccaggaggccgccccggcgcagagcgacguggcccuccugcgcuucgugaaccccgacaccgggcggguccuguucgagugcaagcuccacaaguccggcuacgugaccguggcccacaccgggccccacgaccuggucaucccgcccaacggcuacuuccgcuucgacagcugggugaaccaguucuacacccuggcccccauggggaacggcgccggccggcgccgguga

SEQ ID NO: 12640 - RNA, 1614 nt, Artificial Sequence
  derived and/or modified sequence opt1 from VP1__Norovirus_and/or_Norovirus-like__KX514275
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccauccugacggugggcgagaugaccaacagccgguuccccaucaaccuggagcgccucuucaccgggcccuccagcgccaacgugguccagccccagaacggccggugcaccaucgacggggagcugcugggcacgacccagcucuccagcgugaacaucugcaccuuccgcggcgacgucacccacaucggguccacgcaccacuggaccaugaaccuggccagcccgaacuggaacaacuacgaccccaccgaggagacccccgccccgcugggcacgcccgacuucguggggaagauccacggcaugcucacccagaccacccaggagaacgggagcacgcgggcgcaccgcgccaccguguacgucggcuccgccgacuucacccccaagcugggcaaggugcaguucgagaccgacacggaggacgaccuggccauccggcagaacaccaaguucacccccgugggggucauccagagcuccgaccaccaccgcgacgagccgcagcaguggcggcuccccaacuacagcggcgccaacaccuucaacgugcaccuggcgcccgccguggcccccaacuucccgggggagcagcuccuguucuuccgcuccacgcugcccggcugcgggggccaccccaacauggaccuggacugccuccugccccaggaguggguccagcacuucuaccaggaggccgcgccggcccagagcgacguggcccugcuccgguucgugaaccccgacaccucccgcguccuguucgagugcaagcugcacaagagcggcuacgugaccguggcccacaccgggcaguacgaccucguccugcccuccaacggcuacuuccgguucgacagcugggugaaccaguucuacacgcuggcccccauggggaacggcaccgggcgccgccgguga

SEQ ID NO: 12641 - RNA, 1614 nt, Artificial Sequence
  derived and/or modified sequence opt1 from VP1__Norovirus_and/or_Norovirus-like__KF806510
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucaccgggaccuccgaguacgccaugaaccuggccagccagaacuggaacaacuacgacccgaccgaggagauccccgcgccccucggcgcccccgacuucguggggaagauccgcggcaugcugacgcagaccacccggcgcgacggguccacccggggccaccgcgccacgcugagcaccggcagcgcccacuucaccccgaagcucgggaacauccgguucuccaccgacacgaacaacgacuucgaggccggccagaacaccaaguucacccccgucgggguguuccaggagggcgacaaccaccagaacgagccccagcagugggugcugcccaacuacagcggggcgaccgcccacaacguccaccuggccccggccguggcgcccgccuuccccggcgagcagcuccuguucuuccgcuccacgaugcccggcugcgggggcuacccgaacaugaaccuggacugccuccugccccaggagugggugcagcacuucuaccaggaggccgcccccgcccagagcgacgucgcgcugcuccgguucgugaaccccgacaccucccgcgugcuguucgagugcaagcugcacaagagcggguacgucaccguggcccacaccggccagcacgaccucgugaucccgcccaacggguacuuccgguucgacuccugggucaaccaguucuacacgcuggcccccaugggcaacggcaccgggcgccgccgguga

SEQ ID NO: 12642 - RNA, 1614 nt, Artificial Sequence
  derived and/or modified sequence opt1 from VP1__Norovirus_and/or_Norovirus-like__EU078410
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcagacgauccucgccgggaacgccuucaccgcgggcaagaucaucuucgccgccgucccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgaccccacgaucaagcugaucgccaugcucuacacgccccugcgggccaacaacgcgggcgacgacgucuucaccgugagcugccgcgugcugacccggccgucccccgacuucgacuucaucuuccucgucccgcccaccguggagagccgcaccaagcccuucaccgugcccauccugaccgucgaggagauguccaacagccgguuccccaucccccuggagaagcucuacacgggcccguccagcgccuucguggugcagccccagaacgggcgcugcaccaccgacggcguccugcuggggaccacgcagcucuccgccgugaacaucugcaccuuccggggcgacgucacccacaucgccggcagccacgacuacaccaugaaccuggccucccagaacuggaacaacuacgaccccacggaggagaucccggcgccccuggggacccccgacuucgugggcaagauccaggggaugcucacccagaccacgcgcgaggacggcagcacccgggcccacaaggccaccgugagcaccggguccguccacuucacgcccaagcugggcagcgugcaguacaccaccgacaccaacaacgacuuccaggccggccagaacacgaaguucaccccggugggggucauccaggacggcaacaaccaccagaacgagccccagcagugggugcugcccaacuacuccgggcgcaccggccacaacgugcaccucgcccccgcggucgccccgaccuuccccggggagcagcugcuguucuuccggagcacgaugcccggcugcuccggcuaccccaacaugaaccucgacugccugcugccgcaggagugggugcagcacuucuaccaggaggccgcccccgcgcagagcgacguggcccuccugcgcuucgucaaccccgacaccgggcgggugcuguucgagugcaagcuccacaaguccggcuacgugaccgucgcccacaccgggccccacgaccuggugaucccgcccaacggcuacuuccgcuucgacagcugggugaaccaguucuacacccuggcccccauggggaacggcacgggccggcgccgguga

SEQ ID NO: 12643 - RNA, 1614 nt, Artificial Sequence
  derived and/or modified sequence opt1 from VP1__Norovirus_and/or_Norovirus-like__AF427123
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggguccucacccagaccacccgcgaggacggcagcacgcgggcccacaaggccaccgugagcaccggguccgugcacuucacccccaagcugggcagcguccaguacacgaccgacaccaacaacaacuuccagaccggccagaacacgaaguucacccccgugggggugauccaggacggcaacaaccaccagaacgagccgcagcaguggguccugcccaacuacuccgggcgcaccggccacaacgugcaccucgcccccgccguggcgcccaccuucccgggggagcagcugcuguucuuccggagcacgaugcccggcugcuccggcuaccccaacaugaaccucgacugccugcugccccaggaguggguccagcacuucuaccaggaggccgccccggcccagagcgacguggcgcuccugcgcuucgugaaccccgacaccgggcggguccuguucgagugcaagcuccacaaguccggcuacgugaccguggcccacaccgggccccacgaccuggucaucccgcccaacggcuacuuccgcuucgacagcugggugaaccaguucuacacccuggcccccauggggaacggcgccggccggcgccgguga

SEQ ID NO: 12644 - RNA, 1614 nt, Artificial Sequence
  derived and/or modified sequence opt1 from VP1__Norovirus_and/or_Norovirus-like__AY532135
augaagauggccagcaacgacgccaacccgcccgacggcuccaccgcgaaccuggugcccgaggucaacaacgaggugauggcccucgagcccguggucggggccgccaucgccgcgcccguggccggccagcagaacaucaucgacccguggauccgcaacaacuucgugcaggcccccgggggcgaguucaccgucagcccccggaacgcccccggggagauccugugguccgcgccgcugggccccgaccucaaccccuaccugagccaccuggcccgcauguacaacggcuacgccgggggcuucgagguccaggugauccucgccgggaacgccuucacggcgggcaagaucaucuucgccgccgugcccccgaacuuccccaccgaggggcugucccccagccaggugaccauguucccccacaucaucguggacguccggcagcuggagccggugcucaucccccugcccgacgugcgcaacaacuucuaccacuacaaccaguccaacgacagcaccaucaagcugaucgccaugcucuacacgccccugcgggccaacaacgcgggcgacgacgucuucaccguguccugccgcgugcugacccggccgagccccgacuucgacuucaucuuccucgucccgcccaccguggagucccgcacgaagcccuucaccgugcccauccugaccgucgaggagaugagcaacucccgguuccccaucccccuggagaagcucuacaccggcccgagcuccgccuucguggugcagccccagaacgggcgcugcacgaccgacggcguccugcuggggaccacccagcucagcgccgugaacaucugcacguuccggggcgacgucacccacaucgccggcucccacgacuacaccaugaaccuggccagccagaacuggaacaacuacgaccccaccgaggagaucccggcgccccuggggacgcccgacuucgugggcaagauccagggggugcucacccagaccacccgcgaggacggcuccacgcgggcccacaaggccaccgucagcaccgggagcgugcacuucacccccaagcugggcuccgugcaguacacgaccgacaccaacaacgacuuccagaccggccagaacacgaaguucaccccggucggggugauccaggacggcaacaaccaccagaacgagccccagcagugggugcugcccaacuacagcgggcgcaccggccacaacguccaccucgcccccgccguggcgccgaccuuccccggggagcagcugcuguucuuccgguccacgaugcccggcugcagcggcuaccccaacaugaaccucgacugccugcugccgcaggagugggugcagcacuucuaccaggaggccgcccccgcccaguccgacgucgcgcuccugcgcuucgugaaccccgacaccgggcgggugcuguucgagugcaagcuccacaagagcggcuacgucaccguggcccacaccgggccccacgaccuggugaucccgcccaacggcuacuuccgcuucgacuccugggucaaccaguucuacacccuggcccccauggggaacggcgccggccggcgccgguga

SEQ ID NO: 12645 - RNA, 1614 nt, Artificial Sequence
  derived and/or modified sequence opt1 from VP1__Norovirus_and/or_Norovirus-like__AY532125
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaaggugaucuucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaacgcgggcgacgacguguucaccgucagcugccgcgugcugacccggcccuccccggacuucgacuucaucuuccucgugccgcccaccgucgagagccgcacgaagcccuucaccgugcccauccugaccguggaggagauguccaacagccgguuccccaucccccuggagaagcucuacaccggccccuccagcgccuucgucgugcagccgcagaacgggcgcugcacgaccgacggcguccugcuggggaccacccagcucuccgccgugaacaucugcacguuccggggcgacgugacccacaucgccggcagccacgacuacaccaugaaccuggccucccagaacuggaacaacuacgaccccaccgaggagauccccgcgccgcuggggacgcccgacuucgucggcaagauccaggggaugcucacccagaccacccgcgaggacggcagcacgcgggcccacaaggccaccgugagcaccggguccgugcacuucacccccaagcugggcagcguccaguacacgaccgacaccaacaacgacuuccagaccggccagaacacgaaguucacccccgugggggugauccaggacggcaacaaccaccagaacgagccgcagcaguggguccugcccaacuacuccgggcgcaccggccacaacgugcaccucgcccccgccguggcgcccaccuucccgggggagcagcugcuguucuuccggagcacgaugcccggcugcuccggcuaccccaacaugaaccucgacugccugcugccccaggaguggguccagcacuucuaccaggaggccgccccggcccagagcgacguggcgcuccugcgcuucgugaaccccgacaccgggcggguccuguucgagugcaagcuccacaaguccggcuacgugaccguggcccacaccgggccccacgaccuggucaucccgcccaacggcuacuuccgcuucgacagcugggugaaccaguucuacacccuggcccccauggggaacggcgccggccggcgccgguga

SEQ ID NO: 12646 - RNA, 1614 nt, Artificial Sequence
  derived and/or modified sequence opt1 from VP1__Norovirus_and/or_Norovirus-like__AJ277619
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcuccaacuucguccaggcccccgggggcgaguucaccgugagcccccggaacgcccccggggagauccugugguccgcgccccugggcccggaccucaaccccuaccugagccaccuggcccgcauguacaacggcuacgccgggggccucgaggugcaggucgugcuggccgggaacgccuucacggcgggcaagaucaucuucgccgccgugccgcccaacuucccgaccgaggggcugucccccagccaggucaccauguucccccacaucaucguggacgugcggcagcucgagcccguccugaucccgcugcccgacgugcgcaacaacuucuaccacuacaaccaguccaacgacagcaccaucaagcucaucgccaugcuguacacgccccugcgggccaacgacgcgggcgacgacguguucaccgucuccugccgcgugcucacccggcccagcccggacuucgacuucaucuuccuggugccgcccaccgucgagucccgcacgaagcccuucaccgugcccauccugaccguggaggagaugagcaacucccgguuccccaucccccucgagaagcuguacaccggccccagcuccgccuucgucgugcagccgcagaacgggcgcugcacgaccgacggcguccugcucgggaccacccagcugagcgccgugaacaucugcacguuccggggcgacgugacccacaucgccggcucccacgacuacaccaugaaccuggccagccagaacuggaacaacuacgaccccaccgaggagauccccgcgccgcucgggacgcccgacuucgucggcaagauccaggggaugcugagccagaccacccgcggcgacgacuccacccgggcccacaaggccacggugagcaccggguccgugcacuucacccccaagcugggcagcguccaguacaccacggacaccaacaacgacuucgagaccggccagaacaccaaguucacgcccgugggggugauccaggacggcaacaaccaccagaacgagccgcagcaguggguccuccccaacuacuccgggcgcaccggccacaacgugcaccuggcccccgccguggcgcccaccuucccgggggagcagcuccuguucuuccggagcaccaugcccggcugcuccggcuaccccaacaugaaccuggacugccugcucccccaggaguggguccagcacuucuaccaggaggccgccccggcccagagcgacguggcgcugcugcgcuucgugaaccccgacacggggcggguccucuucgagugcaagcugcacaaguccggcuacgugaccguggcccacaccgggccccacgaccuggucaucccgcccaacggcuacuuccgcuucgacagcugggugaaccagcucuacacccuggcccccauggggaacggcgccggccggcgccgguga

SEQ ID NO: 12647 - RNA, 1614 nt, Artificial Sequence
  derived and/or modified sequence opt1 from VP1__Norovirus_and/or_Norovirus-like__AF080556
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucagcaccggguccgugcacuucacccccaagcugggcagcgugcaguacacgaccgacaccaacaacgacuuccaggccggccagaacaccaaguucacgcccgucggggugauccaggacggcaacaaccaccagaacgagccgcagcagugggugcugcccaacuacuccgggcgcaccggccacaacguccaccucgcccccgcgguggcccccaccuucccgggggagcagcugcuguucuuccggagcaccaugcccggcugcuccggcuaccccaacaugaaccucgacugccugcugccccaggagugggugcagcacuucuaccaggaggccgccccggcgcagagcgacgucgcccuccugcgcuucgugaaccccgacacggggcgggugcuguucgagugcaagcuccacaaguccggcuacgucaccguggcccacaccgggccccacgaccuggugaucccgcccaacggcuacuuccgcuucgacagcugggucaaccaguucuacacccuggcccccauggggaacggcgccggccggcgccgguga

SEQ ID NO: 12648 - RNA, 1614 nt, Artificial Sequence
  derived and/or modified sequence opt1 from VP1__Norovirus_and/or_Norovirus-like__AF080550
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcuccgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacgugacccacaucgccggcucccacgacuacaccaugaaccuggccagccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucuccaccgggagcgugcacuucacccccaagcugggcuccgugcaguacacgaccgacaccaacaacgacuuccagaccggccagaacacgaaguucacccccgucggggugauccaggacggcaacaaccaccagaacgagccgcagcagugggugcugcccaacuacagcgggcgcaccggccacaacguccaccucgcccccgccguggcgcccaccuucccgggggagcagcugcuguucuuccgguccacgaugcccggcugcagcggcuaccccaacaugaaccucgacugccugcugccccaggagugggugcagcacuucuaccaggaggccgccccggcccaguccgacgucgcgcuccugcgcuucgugaaccccgacaccgggcgggugcuguucgagugcaagcuccacaagagcggcuacgucaccguggcccacaccgggccccacgaccuggugaucccgcccaacggcuacuuccgcuucgacuccugggucaaccaguucuacacccuggcccccauggggaacggcgccggccggcgccgguga

SEQ ID NO: 12649 - RNA, 1614 nt, Artificial Sequence
  derived and/or modified sequence opt1 from VP1__Norovirus_and/or_Norovirus-like__EU078407
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcggcgacgggagcacgcgggcccacaaggccaccgucagcaccggcuccgugcacuucacccccaagcugggcagcgugcaguucacgaccgacaccaacaacgacuuccagaccgggcagaacacgaaguucacccccgucggcgugauccaggacggggacaaccaccagaacgagccgcagcagugggugcugcccaacuacuccggccgcaccgggcacaacguccaccucgcccccgccguggcgcccaccuucccgggcgagcagcugcuguucuuccggagcacgaugcccggcugcuccggguaccccaacaugaaccucgacugccugcugccccaggagugggugcagcacuucuaccaggaggccgccccggcccagagcgacgucgcgcuccugcgcuucgugaaccccgacaccggccgggugcuguucgagugcaagcuccacaaguccggguacgucaccguggcccacaccggcccccacgaccuggugaucccgcccaacggguacuuccgcuucgacagcugggucaaccaguucuacacccuggcccccaugggcaacggcacggggcggcgccgguga

SEQ ID NO: 12650 - RNA, 1614 nt, Artificial Sequence
  derived and/or modified sequence opt1 from VP1__Norovirus_and/or_Norovirus-like__AB083781
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcuccaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacgcugcggggcgacgugacccacaucgccggcucccacgacuacaccaugaaccuggccagccagaacuggaacaacuacgaccccaccgaggagauccccgcgccgcucgggacgcccgacuucgugggcaagauccaggggaugcugagccagaccacccgcggcgacggguccacccgggcccacaaggccacggucagcaccggcuccgugcacuucacccccaagcugggcagcgugcaguacaccacggacaccaacaacgacuucgagaccgggcagaacaccaaguucacgcccgucggcgugauccaggacgggaacaaccaccagaacgagccgcagcagugggugcuccccaacuacuccggccgcaccgggcacaacguccaccuggcccccgccguggcgcccaccuucccgggcgagcagcuccucuucuuccggagcaccaugcccggcugcuccggguaccccaacaugaaccuggacugccugcucccccaggagugggugcagcacuucuaccaggaggccgccccggcccagagcgacgucgcgcugcugcgcuucgugaaccccgacacgggccgggugcuguucgagugcaagcugcacaaguccggguacgucaccguggcccacaccggcccccacgaccuggugaucccgcccaacggguacuuccgcuucgacagcugggucaaccaguucuacacccucgcccccaugggcaacggcgccgggcggcgccgguga

SEQ ID NO: 12651 - RNA, 1614 nt, Artificial Sequence
  derived and/or modified sequence opt1 from VP1__Norovirus_and/or_Norovirus-like__AF427122
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccggcucuccgccgucaacaucugcacguuccgcggcgacgugacccacaucgccggcagccgggacuacaccaugaaccuggccucccagaacuggaacaacuacgaccccaccgaggagauccccgcgccgcuggggacgcccgacuucgugggcaagauccaggggguccucacccagaccacccgcgaggacggcagcacgcgggcccacaaggccaccgugagcaccggguccgugcacuucacccccaagcugggcagcguccaguacacgaccgacaccaacaacgacuuccagaccggccagaacacgaaguucacccccgugggggugauccaggacggcaacaaccaccagaacgagccgcagcaguggguccugcccaacuacuccgggcgcaccggccacaacgugcaccucgcccccgccguggcgcccaccuucccgggggagcagcugcuguucuuccggagcacgaugcccggcugcuccggcuaccccaacaugaaccucgacugccugcugccccaggaguggguccagcacuucuaccaggaggccgccccggcccagagcgacguggcgcuccugcgcuucgugaaccccgacaccgggcggguccuguucgagugcaagcuccacaaguccggcuacgugaccguggcccacaccgggccccacgaccuggucaucccgcccaacggcuacuuccgcuucgacagcugggugaaccaguucuacacccuggcccccauggggaacggcgugggccggcgccgcuga

SEQ ID NO: 12652 - RNA, 1614 nt, Artificial Sequence
  derived and/or modified sequence opt1 from VP1__Norovirus_and/or_Norovirus-like__AY532133
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccuguccccggaccucaaccccuaccugagccaccuggcccgcauguacaacggcuacgccggcggguucgaggugcaggucauccucgccggcaacgccuucacggcggggaagaucaucuucgccgccgugccgcccaacuucccgaccgagggccugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggggacgacguguucaccguguccugccgcguccugacccggcccagcccggacuucgacuucaucuuccucgugccgcccaccguggagucccgcaucaagcccuucacgguccccauccugaccguggaggagaugagcaacucccgguuccccaucccccuggagaagcucuacaccggccccagcuccgccuucgugguccagccgcagaacggccgcugcaccacggacggggugcugcugggcaccacccagcucagcgccgucaacaucugcaccuuccgcggggacgugacgcacaucgccggcucccacgacuacaccaugaaccuggccagccagaacuggaacaacuacgaccccaccgaggagauccccgcgccgcugggcacccccgacuucguggggaagauccagggcaugcucacgcagaccacccgggaggacgggagcacccgggcccacaaggccacggucuccaccggcagcgugcacuucacccccaagcugggguccgugcaguacaccacggacaccaacaacgacuuccagaccggccagaacaccaaguucacgcccgucggcgugauccaggacgggaacaaccaccagaacgagccgcagcagugggugcugcccaacuacagcggccgcaccgggcacaacguccaccucgcccccgccguggcgcccaccuucccgggcgagcagcugcuguucuuccgguccaccaugcccgggugcagcggcuaccccaacaugaaccucgacugccugcugccccaggagugggugcagcacuucuaccaggaggccgccccggcccaguccgacgucgcgcuccugcgcuucgugaaccccgacacgggccgggugcuguucgagugcaagcuccacaagagcggguacgucaccguggcccacaccggcccccacgaccuggugaucccgcccaacggguacuuccgcuucgacuccugggucaaccaguucuacacccuggcccccaugggcaacggggccggccggcgccgguga

SEQ ID NO: 12653 - RNA, 1614 nt, Artificial Sequence
  derived and/or modified sequence opt1 from VP1__Norovirus_and/or_Norovirus-like__AY532131
augaagauggccagcaacgacgccaaccccuccgacggcagcaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugucccaccuggcccgcguguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucagcaccggguccgugcacuucacccccaagcugggcagcgugcaguacacgaccgacaccaacaacgacuuccagaccggccagaacacgaaguucacccccgucggggugauccaggacggcaacaaccaccagaacgagccgcagcagugggugcugcccuccuacagcgggcgcaccggccacaacguccaccucgcccccgccguggcgcccaccuucccgggggagcagcugcuguucuuccgguccacgaugcccggcugcagcggcuaccccaacaugaaccucgacugccugcugccccaggagugggugcagcacuucuaccaggaggccgccccggcccaguccgacgucgcgcuccugcgcuucgugaaccccgacaccgggcgggugcuguucgagugcaagcuccacaagagcggcuacgucaccguggcccacaccgggccccacgaccuggugaucccgcccaacggcuacuuccgcuucgacuccugggucaaccaguucuacacccuggcccccauggggaacggcgccggccggcgccgguga

SEQ ID NO: 12654 - RNA, 1614 nt, Artificial Sequence
  derived and/or modified sequence opt1 from VP1__Norovirus_and/or_Norovirus-like__AY532121
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaaggugaucuucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaacgcgggcgacgacguguucaccgucagcugccgcgugcugacccggcccuccccggacuucgacuucaucuuccucgugccgcccaccgucgagagccgcacgaagcccuucaccgugcccauccugaccguggaggagauguccaacagccgguuccccaucccccuggagaagcucuacaccggccccuccagcgccuucgucgugcagccgcagaacgggcgcugcacgaccgacggcguccugcuggggaccacccagcucuccgccgugaacaucugcacguuccggggcgacgugacccacaucgccggcagccacgacuacaccaugaaccuggccucccagaacuggaacaacuacgaccccaccgaggagauccccgcgccgcuggggacgcccgacuucgucggcaagauccaggggacccucacccagaccacgcgcgaggacggcagcacccgggcccacaaggccaccgugagcaccggguccgugcacuucacgcccaagcugggcagcguccaguacaccaccgacaccaacaacgacuuccagacgggccagaacaccaaguucacccccgugggggugauccaggacggcaacaaccaccagaacgagccgcagcaguggguccugcccaacuacuccgggcgcaccggccacaacgugcaccucgcccccgccguggcgcccacguucccgggggagcagcugcuguucuuccggagcaccaugcccggcugcuccggcuaccccaacaugaaccucgacugccugcugccccaggaguggguccagcacuucuaccaggaggccgccccggcccagagcgacguggcgcuccugcgcuucgugaaccccgacaccgggcggguccuguucgagugcaagcuccacaaguccggcuacgugaccguggcccacaccgggccccacgaccuggucaucccgcccaacggcuacuuccgcuucgacagcuggaucaaccaguucuacacgcuggcccccauggggaacggcgccggccggcgccgguga

SEQ ID NO: 12655 - RNA, 1614 nt, Artificial Sequence
  derived and/or modified sequence opt1 from VP1__Norovirus_and/or_Norovirus-like__AY532115
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgacgugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucagcaccggguccgugcacuucacccccaagcugggcagcgugcaguacacgaccgacaccaacaacgacuuccagaccggccagaacacgaaguucacccccgucggggugauccaggacggcaacaaccaccagaacgagccgcagcagugggugcugcccaacuacuccgggcgcaccggccacaacguccaccucgcccccgccguggcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacgucgcgcuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcugggucaaccaguucuacacccuggcccccauggggaacggcgccggccggcgccgguga

SEQ ID NO: 12656 - RNA, 1614 nt, Artificial Sequence
  derived and/or modified sequence opt1 from VP1__Norovirus_and/or_Norovirus-like__KF806530
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucgccgggacccacgaguacgccaugaaccuggcgucccagaacuggaacaacuacgacccgaccgaggagauccccgcgccccucggcgcccccgacuucguggggaagauccgcggcguccugacccagacgacccggcgcgacgggagcacccggggccaccgcgccacccuguccacgggcagcgcccacuucaccccgaagcucgggagcauccgguucuccaccgacaccaacaacgacuucgaggccggccagaacacgaaguucacccccguggggguguuccaggacggcgacaaccaccagaacgagccccagcaguggguccugcccaacuacagcggggccaccgcccacaacgugcaccuggccccggcgguggcccccgccuuccccggcgagcagcuccuguucuuccgcuccaccaugcccggcugcagcggguacccgaacaugaaccuggacugccuccugccccaggaguggguccagcacuucuaccaggaggccgcccccgcgcaguccgacguggcccugcuccgguucgugaaccccgacacgagccgcguccuguucgagugcaagcugcacaaguccggcuacgugaccguggcccacaccgggcagcacgaccucgucaucccgcccaacggcuacuuccgguucgacagcugggugaaccaguucuacacccuggcccccauggggaacggcacgggccgccgccgguga

SEQ ID NO: 12657 - RNA, 1614 nt, Artificial Sequence
  derived and/or modified sequence opt1 from VP1__Norovirus_and/or_Norovirus-like__KF806513
augaagauggccagcaacgacgccucccccagcgacggcuccgcggccaaccuggugccggaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucgucguggacgugcggcagcuggagcccguccucaucccgcugcccgacgugcgcaacaacuucuaccacuacaaccagagcaaggaccccaccaucaagcugaucgccaugcucuacacgccccugcgggcgaacaacgccggcgaggacguguucaccgucuccugccgcgugcugacccggccgagccccgacuucgacuucaucuuccucgugccgcccaccgucgagucccgcagcaagcccuucaccgugcccauccugacgguggaggagaugaccaacucccgguuccccaucccccuggagaagcuguucaccggcccgagcggggccuucgucgugcagccccagaacggccgcugcaccacggacgggguccuccugggcaccacccagcucucccccgugaacaucugcaccuuccggggcgaccugacgcacuucaccgggaccagcgaguacgccaugaaccuggccucccagaacuggaacaacuacgacccgaccgaggagauccccgcgccccucggcgcccccgacuucguggggaagauccgcggcaugcugacgcagaccacccggcgcgacgggagcacccggggccaccgcgccacgcugagcaccggcuccgcccacuucaccccgaagcucgggagcauccgguucuccaccgacacgaacaacgacuucgaggccagccagaacaccaaguucacccccgucggcguguuccaggagggggacaaccaccagaacgagccccagcagugggugcugcccaacuacuccggcgcgaccgcccacaacguccaccuggccccggccguggcgcccgccuuccccggggagcagcuccuguucuuccgcagcacgaugcccggcugcggcggguacccgaacaugaaccuggacugccuccugccccaggagugggugcagcacuucuaccaggaggccgcccccgcccaguccgacgucgcgcugcuccgguucgugaaccccgacaccagccgcgugcuguucgagugcaagcugcacaaguccggcuacgucaccguggcccacaccgggcagcacgaccucgugaucccgcccaacggcuacuuccgguucgacagcugggucaaccaguucuacacgcuggcccccauggggaacggcaccggccgccgccgguga

SEQ ID NO: 12658 - RNA, 1614 nt, Artificial Sequence
  derived and/or modified sequence opt1 from VP1__Norovirus_and/or_Norovirus-like__AY741811
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaaggugaucuucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugaaggccaacaacgcgggcgacgacguguucaccgucagcugccgggugcugacccgccccuccccggacuucgacuucaucuuccucgugccgcccaccgucgagagccggacgaagcccuucaccgugcccauccugaccguggaggagauguccaacagccgcuuccccaucccccuggagaagcucuacaccggccccuccagcgccuucgucgugcagccgcagaacgggcggugcacgaccgacggcguccugcuggggaccacccagcucuccgccgugaacaucugcacguuccgcggcgacgugacccacaucgccggcagccacgacuacaccaugaaccuggccucccagaacuggaacaacuacgaccccaccgaggagauccccgcgccgcuggggacgcccgacuucgucggcaagauccaggggaugcucacccagaccacccgggaggacggcagcacgcgcgcccacaaggccaccgugagcaccggguccgugcacuucacccccaagcugggcagcguccaguacacgaccgacaccaacaacgacuuccagaccggccagaacacgaaguucacccccgugggggugauccaggacggcaacaaccaccagaacgagccgcagcaguggguccugcccaacuacuccgggcggaccggccacaacgugcaccucgcccccgccguggcgcccaccuucccgggggagcagcugcuguucuuccgcagcacgaugcccggcugcuccggcuaccccaacaugaaccucgacugccugcugccccaggaguggguccagcacuucuaccaggaggccgccccggcccagagcgacguggcgcuccugcgguucgugaaccccgacaccgggcgcguccuguucgagugcaagcuccacaaguccggcuacgugaccguggcccacaccgggccccacgaccuggucaucccgcccaacggcuacuuccgguucgacagcugggugaaccaguucuacacccuggcccccauggggaacggcgccggccgccggcgcuga

SEQ ID NO: 12659 - RNA, 1614 nt, Artificial Sequence
  derived and/or modified sequence opt1 from VP1__Norovirus_and/or_Norovirus-like__AY532122
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaaggugaucuucgccgccgugccgcccaacuucccgaccgaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaacgcgggcgacgacguguucaccgucagcugccgcgugcugacccggcccuccccggacuucgacuucaucuuccucgugccgcccaccgucgagagccgcacgaagcccuucaccgugcccauccugaccguggaggagauguccaacagccgguuccccaucccccuggagaagcucuacaccggccccuccagcgccuucgucgugcagccgcagaacgggcgcugcacgaccgacggcguccugcuggggaccacccagcucuccgccgugaacaucugcacguucggcggcgacgugacccacaucgccgggagccacgacuacaccaugaaccuggccucccagaacuggaacaacuacgaccccaccgaggagauccccgcgccgcugggcacgcccgacuucgucgggaagauccagggcaugcucacccagaccacccgggaggacgggagcacgcgcgcccacaaggccaccgugagcaccggcuccgugcacuucacccccaagcugggcagcguccaguacacgaccgacaccaacaacgacuuccagaccgggcagaacacgaaguucacccccgugggcgugauccaggacggggacaaccaccagaacgagccgcagcaguggguccugcccaacuacuccggccggaccgggcacaacgugcaccucgcccccgccguggcgcccaccuucccgggcgagcagcugcuguucuuccgcagcacgaugcccggcugcuccggguaccccaacaugaaccucgacugccugcugccccaggaguggguccagcacuucuaccaggaggccgccccggcccagagcgacguggcgcuccugcgguucgugaaccccgacaccggccgcguccuguucgagugcaagcuccacaaguccggguacgugaccguggcccacaccggcccccacgaccuggucaucccgcccaacggguacuuccgguucgacagcugggugaaccaguucuacacccuggcccccaugggcaacggcgccgggcgccggcgcuga

SEQ ID NO: 12660 - RNA, 1614 nt, Artificial Sequence
  derived and/or modified sequence opt1 from VP1__Norovirus_and/or_Norovirus-like__AY532120
augaagauggccagcaacgacgccaaccccuccgacggcagcaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggcgggcaagaucaucuucgccgccgugccgcccaacuucccgaccgaggggcugagccccucccaggugaccauguucccccacaucaucguggacguccggcagcuggagcccgugcucaucccgcugcccgacgugcgcaacagcuucuaccacuacaaccaguccaacgacagcaccaucaagcugaucgccaugcucuacacgccccugcgggccaacaacgcgggcgacgacgucuucaccguguccugccgcgugcugacccggcccagcccggacuucgacuucaucuuccucgucccgcccaccguggagucccgcacgaagcccuucaccgugcccauccugaccgucgaggagaugagcaacucccgguuccccaucccccuggagaagcucuacaccggccccagcuccgccuucguggugcagccgcagaacgggcgcugcacgaccgacggcguccugcuggggaccacccagcucagcgccgugaacaucugcacguuccggggcgacgucacccacaucgccggcucccacgacuacaccaugaaccuggccagccagaacuggaacaacuacgaccccaccgaggagauccccgcgccgcuggggacgcccgacuucgugggcaagauccaggggaugcucacccagaccacccgcgaggacggcagcacgcgggcccacaaggccaccguguccaccgggagcguccacuucacccccaagcugggcuccgugcaguacacgaccgacaccaacagcgacuuccagaccggccagaacacgaaguucacccccgugggggucauccaggacggcaacaaccaccagaacgagccgcagcagugggugcugcccaacuacuccgggggcaccgggcacaacgugcaccucgcccccgccgucgcgcccaccuucccgggcgagcagcugcuguucuuccgcagcacgaugcccggcugcuccggguaccccaacaugaaccucgacugcuacagcccccaggagugggugcagcacuucuaccaggaggccgccccggcccaguccgacguggcgcugcugcgguucgucaaccccgacaccggccgcguccucuucgagugcaagcugcacaagagcggguacgugaccguggcccacaccggcccccacgaccuggugaucccgcccaacggguacuuccgguucgacuccugggugaaccaguucuacacccucgcccccaugggcaacggcgccgggcgccggcgcuga

SEQ ID NO: 12661 - RNA, 1614 nt, Artificial Sequence
  derived and/or modified sequence opt1 from VP1__Norovirus_and/or_Norovirus-like__AY532111
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccuguccccggaccucaaccccuaccugagccaccuggcccgcauguacaacggcuacgccggcggguucgaggugcaggucauccucgccggcaacgccuucacggcggggaagaucaucuucgccgccgugccgcccaacuucccgaccgagggccugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggggacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacggccgcugcacgaccgacggggugcugcugggcaccacccagcucagcgccgucaacaucugcacguuccgcggggacgugacccacaucgccggcucccacgacuacaccaugaaccuggccagccagaacuggaacaacuacgaccccaccgaggagauccccgcgccgcugggcacgcccgacuucguggggaagauccagggcaugcucacccagaccacccgggaggacgggagcacgcgggcccacaaggccaccgucuccaccggcagcgugcacuucacccccaagcugggguccgugcaguacacgaccgacaccaacaacgacuuccagaccggccagaacacgaaguucacccccgucggcgugauccaggacgggaacaaccaccagaacgagccgcagcagugggugcugcccaacuacagcggccgcaccgggcacaacguccaccucgcccccgccguggcgcccaccuucccgggcgagcagcugcuguucuuccgguccacgaugcccgggugcagcggcuaccccaacaugaaccucgacugccugcugccccaggagugggugcagcacuucuaccaggaggccgccccggcccaguccgacgucgcgcuccugcgcuucgugaaccccgacaccggccgggugcuguucgagugcaagcuccacaagagcggguacgucaccguggcccacaccggcccccacgaccuggugaucccgcccaacggguacuuccgcuucgacuccugggucaaccagguguacacccuggcccccaugggcaacggggccggccggcgccgguga

SEQ ID NO: 12662 - RNA, 1614 nt, Artificial Sequence
  derived and/or modified sequence opt1 from VP1__Norovirus_and/or_Norovirus-like__AF080558
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcggcgacgggagcacgcgggcccacaaggccaccgucagcaccggcuccgugcacuucacccccaagcugggcagcgugcaguucacgaccgacaccaacaacgacuuccagaccgggcagaacacgaaguucacccccgucggcgugacccaggacggggacaaccaccagaacgagccgcagcagugggugcugcccaacuacuccggccgcaccgggcacaacguccaccucgcccccgccguggcgcccacguucccgggcgagcagcugcuguucuuccggagcaccaugcccggcugcuccggguaccccaacaugaaccucgacugccugcugccccaggagugggugcagcacuucuaccaggaggccgccccggcccagagcgacgucgcgcuccugcgcuucgugaaccccgacaccggccgggugcuguucgagugcaagcuccacaaguccggguacgucaccguggcccacaccggcccccacgaccuggugaucccgcccaacggguacuuccgcuucgacagcugggucaaccaguucuacacgcuggcccccaugggcaacggcgccgggcggcgccgguga

SEQ ID NO: 12663 - RNA, 1614 nt, Artificial Sequence
  derived and/or modified sequence opt1 from VP1__Norovirus_and/or_Norovirus-like__KF806508
augaagauggccagcaacgacgccucccccagcgacggcuccgcggccaaccuggugccggaggucagcaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucgucguggacgugcggcagcuggagcccguccucaucccgcugcccgacgugcgcaacaacuucuaccacuacaaccagagcaaggaccccaccaucaagcugaucgccaugcucuacacgccccugcgggcgaacaacgccggcgaggacguguucaccgucuccugccgcgugcugacccggccgagccccgacuucgacuucaucuuccucgugccgcccaccgucgagucccgcagcaagcccuucaccgugcccauccugacgguggaggagaugaccaacucccgguuccccaucccccuggagaagcuguucaccggcccgagcggggccuucgucgugcagccccagaacggccgcugcaccacggacgggguccuccugggcaccacccagcucucccccgugaacaucugcaccuuccggggcgaccugacgcacuucaccgggaccagcgaguacgccaugaaccuggccucccagaacuggaacaacuacgacccgaccgaggagauccccgcgccccucggcgcccccgacuucguggggaagauccgcggcaugcugacgcagaccacccggcgcgacgggagcacccggggccaccgcgccacgcugagcaccggcuccgcccacuucaccccgaagcucgggagcauccgguucuccaccgacacgaacaacgacuucgaggccggccagaacaccaaguucacccccgucgggaucuuccaggagggcgacaaccaccagaacgagccccagcagugggugcugcccaacuacagcggggcgaccgcccacaacgugcaccuggccccggccgucgcgcccgccuuccccggcgagcagcuccuguucuuccgcuccacgaugcccggcugcgggggcuacccgaacaugaaccuggacugccuccugccccaggagugggugcagcacuucuaccaggaggccgcccccgcccagagcgacguggcgcugcuccgguucgucaaccccgacaccucccgcgugcuguucgagugcaagcugcacaagagcggguacgugaccgucgcccacaccggccagcacgaccucgugaucccgcccaacggguacuuccgguucgacuccugggugaaccaguucuacacgcuggcccccaugggcaacggcaccgggcgccgccgguga

SEQ ID NO: 12664 - RNA, 1614 nt, Artificial Sequence
  derived and/or modified sequence opt1 from VP1__Norovirus_and/or_Norovirus-like__AF425766
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucauccaggcccccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggcgggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggccaacaacgcgggcgacgacgucuucaccgugagcugccgcgugcugacccggcccuccccggacuucgacuucaucuuccucgucccgcccaccguggagagccgcacgaagcccuucaccgugcccauccugaccgucgaggagauguccaacagccgguuccccaucccccuggagaagcucuacaccggccccuccagcgccuucguggugcagccgcagaacgggcgcugcacgaccgacggcguccugcuggggaccacccagcucuccgccgugaacaucugcacguuccggggcgacgucacccacaucgccggcagccacgacuacaccaugaaccuggccucccagaacuggaacaacuacgaccccaccgaggagauccccgcgccgcuggggacgcccgaccucgugggcaagauccaggggaugcugacccagaccacccgcgaggacggcagcacgcgggcccacaaggccaccgugagcaccggguccguccacuucacccccaagcugggcagcgugcaguacacgaccgacaccuccaacgacuuccagaccggccagaacacgaaguucacccccgugggggucauccaggacggcaacaaccaccagaacgagccgcagcagugggugcuccccaacuacagcgggcgcaccggccacaacgugcaccuggcccccgccgucgcgcccaccuucccgggggagcagcuccucuucuuccgguccacgaugcccggcugcagcggcuaccccaacaugaaccuggacugccugcucccccaggagugggugcagcacuucuaccaggaggccgccccggcccaguccgacguggcgcugcugcgcuucgucaaccccgacaccgggcgggugcuguucgagugcaagcugcacaagagcggcuacgugaccgucgcccacaccgggccccacgaccuggugaucccgcccaacggcuacuuccgcuucgacuccugggugaaccaguucuacacccucgcccccauggggaacggcgccggccggcgccgguga

SEQ ID NO: 12665 - RNA, 1614 nt, Artificial Sequence
  derived and/or modified sequence opt1 from VP1__Norovirus_and/or_Norovirus-like__AJ583672
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaccaucuucgccgccgugccgcccaacuucccgaccgaggggcugagccccucccaggugaccauguucccccacaucaucgucgacgugcggcagcccgagccggugcugaucccccuccccgacguccgcaacaacuucuaccacuacaaccagagcaacgaccccacgaucaagcugaucgccaugcuguacaccccgcuccgggccaacaacgcgggcgacgacguguucaccguguccugccgcguccugacccggcccagccccgacuucgacuucaucuuccuggugcccccgacgguggagucccgcaccaagcccuucaccguccccauccucaccguggaggagaugacgaacagccgguuccccaucccgcuggagaagcuguucaccggccccuccaacgccuucgugguccagccccagaacgggcgcugcaccaccgacggcgugcuccuggggacgacccagcugagcccggucaacaucugcaccuuccggggcgacgugacccacaucgccggcacgcacgacuacaccaugaaccucgccucccagaacuggaacaacuacgaccccaccgaggagauccccgcgccccuggggaccccggacuucgugggcaagauccaggggguccugagccagacgacccgcggcgacggguccacccggggccacaaggccaccgugagcacgggcuccgugcacuucacccccaagcucgggagcguccaguacaccaccgacacgaacaacgaccuggaggccggccagagcaccaaguucacccccgugggggugguccaggacggcaacaaccaccagaacgagccccagcagugggugcugccgaacuacuccgggcgcaccggccacaacgugcaccucguccccgccguggcccccacguuccccggcgagcagcugcuguucuuccggagcaccaugccggggugcuccggcuaccccaacaugaaccucgacugccugcugccccaggagugggugcagcacuucuaccaggaggccgcgcccgcccagagcgacgucgcccuccugcgcuucgugaacccggacaccgggcgggugcuguucgagugcaagcuccacaaguccggcuacgucaccguggcccacaccgggccccacgaccuggugaucccgcccaacggcuacuuccgcuucgacagcugggucaaccaguucuacacgcuggcgcccaugggcaacgggaccggccggcgccgguga

SEQ ID NO: 12666 - RNA, 1614 nt, Artificial Sequence
  derived and/or modified sequence opt1 from VP1__Norovirus_and/or_Norovirus-like__AY532119
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacgugacccacaucgccggcucccacgacuacaccaugaaccuggccagccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucuccaccgggagcgugcacuucacccccaagcugggcuccgugcaguacacgaccgacaccaacagcgacuuccagaccggccagaacacgaaguucacccccgucggggugauccaggacggcaacaaccaccagaacgagccgcagcagugggugcugcccaacuacuccgggcgcaccggccacaacguccaccucgcccccgccguggcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacgucgcgcuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcugggucaaccaguucuacacccuggcccccauggggaacggcgccggccggcgccgguga

SEQ ID NO: 12667 - RNA, 1614 nt, Artificial Sequence
  derived and/or modified sequence opt1 from VP1__Norovirus_and/or_Norovirus-like__AF080552
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucagcaccggguccgugcacuucacccccaagcugggcagcgugcaguacacgaccgacaccaacaacgacuuccagaccggccagaacacgaaguucacccccgucggggugauccaggacggcaacaaccaccagaacgagccgcagcagugggugcugcccaacuacuccgggcgcaccggccacaacguccaccucgcccccgccguggcgcccaccuucccgggggagcagcugcuguucuuccggagcacgaugcccggcugcuccggcuaccccaacaugaaccucgacugccugcugccccaggagugggugcagcacuucuaccaggaggccgccccggcccagagcgacgucgcgcuccugcgcuucgugaaccccgacaccgggcgggugcuguucgagugcaagcuccacaaguccggcuacgucaccguggcccacaccgggccccacgaccuggugaucccgcccagcggcuacuuccgcuucgacuccugggucaaccaguucuacacccuggcccccauggggaacggcgccggccggcgccgguga

SEQ ID NO: 12668 - RNA, 1614 nt, Artificial Sequence
  derived and/or modified sequence opt1 from VP1__Norovirus_and/or_Norovirus-like__KX514177
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccgugaaccuggagcgccucuucaccgggcccuccagcgccaacgucgugcagccgcagaacggccggugcacgaucgacggggagcugcugggcaccacccagcucuccagcgucaacaucugcaccuuccgcggcgacgugacgcacaucgggaccacccagcacuggaccaugaaccuggccucccccaacuggaacaacuacgaccccacggaggagaccccggcgccccugggcacccccgacuucguggggaagauccacggcaugcucacccagacgacccaggagaacgggagcacccgggcccaccgcgccaccgucuacgugggcagcgccaacuucacgcccaagcugggcaaggugcaguucgagaccgacaccggggacgaccuggccauccggcagaacaccaaguucacgccggucggcgugauccaguccagcgaccaccaccgcgacgagccccagcaguggcggcuccccaacuacuccggggccaacaccuucaacgugcaccuggcccccgcggucgccccgaacuuccccggcgagcagcuccuguucuuccgcagcacccugcccgggugcggcggccaccccaacauggaccuggacugccuccugccgcaggagugggugcagcacuucuaccaggaggccgcccccgcgcaguccgacguggcccugcuccgguucgucaaccccgacaccagccgcgugcuguucgagugcaagcugcacaaguccggguacgugacggucgcccacaccggccaguacgaccucgugcugcccagcaacggguacuuccgguucgacuccugggugaaccaguucuacacccuggccccgaugggcaacgggaccggccgccgccgguga

SEQ ID NO: 12669 - RNA, 1614 nt, Artificial Sequence
  derived and/or modified sequence opt1 from VP1__Norovirus_and/or_Norovirus-like__KF806514
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucaccgggaccuccgaguacgccaugaaccuggccagccagaacugggacaacuacgacccgaccgaggagauccccgcgccccucggcgcccccgacuucguggggaagauccgcggcaugcugacgcagaccacccggcgcgacggguccacccggggccaccgcgccacgcugagcaccggcagcgcccacuucaccccgaagcucgggaacauccgguucuccaccgacacgaacaacgacuucgaggccggccagaacaccaaguucacccccgucgggguguuccaggagggcgacaaccaccagaacgagccccagcagugggugcugcccaacuacagcggggcgaccgcccacaacguccaccuggccccggccguggcgcccgccuuccccggcgagcagcuccuguucuuccgcuccacgaugcccggcugcgggggcuacccgaacaugaaccuggacugccuccugccccaggagugggugcagcacuucuaccaggaggccgcccccgcccagagcgacgucgcgcugcuccgguucgugaaccccgacaccucccgcgugcuguucgagugcaagcugcacaagagcggguacgucaccguggcccacaccggccagcacgaccucgugaucccgcccaacggguacuuccgguucgacuccugggucaaccaguucuacacgcuggcccccaugggcaacggcaccgggcgccgccgguga

SEQ ID NO: 12670 - RNA, 1614 nt, Artificial Sequence
  derived and/or modified sequence opt1 from VP1__Norovirus_and/or_Norovirus-like__AB303925
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcuguucaccggccccuccagcgccuucgugguccagccgcagaacgggcgcugcacgaccgacggcgugcuccuggggaccacccagcucuccgccgucaacaucugcacguuccggggcgacgugacccacaucgccggcagccacgacuacaccaugaaccuggccucccagaacuggaacaacuacgaccccaccgaggagauccccgcgccgcuggggacgcccgacuucgugggcaagauccaggggaugcucacccagaccacccgcgaggacggcagcacgcgggcccacaaggccaccgucagcaccggguccgugcacuucacccccaagcugggcagcgugcaguacacgaccgacaccaacaacgacuuccagaccggccagaacacgaaguucacccccgucggggugauccaggacggcaacaaccaccagaacgagccgcagcagugggugcugcccaacuacuccgggcgcaccggccacaacguccaccucgcccccgccguggcgcccaccuucccgggggagcagcugcuguucuuccggagcacgaugcccggcugcuccggcuaccccaacauggaccucgacugccugcugccccaggagugggugcagcacuucuaccaggaggccgccccggcccagagcgacgucgcgcuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcuggaucaaccaguucuacacccuggcccccauggggaacggcgccggccggcgccgguga

SEQ ID NO: 12671 - RNA, 1614 nt, Artificial Sequence
  derived and/or modified sequence opt1 from VP1__Norovirus_and/or_Norovirus-like__KF806534
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgaccugacgcacuucgccggcaccagcgaguacgccaugaaccuggcgucccagaacuggaccaacuacgacccgaccgaggagauccccgcgccccucggggcccccgacuucgugggcaagauccgcgggguccugacgcagaccacccggcgcgacggcagcacccgggggcaccgcgccacgcugagcaccggcuccgcccacuucaccccgaagcucggcagcauccgguucuccaccgacacgaacaacgacuucgaggccgggcagaacaccaaguucacccccgugggcguguuccaggacggggacaaccaccagaacgagccccagcaguggguccugcccaacuacagcggcgccaccgcccacaacgugcaccuggccccggcgguggcccccgccuuccccggggagcagcuccuguucuuccgcuccacgaugcccggcugcagcggcuacccgaacaugaaccuggacugccuccugccccaggaguggguccagcacuucuaccaggaggccgcccccgcgcaguccgacguggcccugcuccgguucgugaaccccgacaccagccgcguccuguucgagugcaagcugcacaaguccggguacgugaccguggcccacaccggccagcacgaccucgucaucccgcccaacggguacuuccgguucgacagcugggugaaccaguucuacacgcuggcccccaugggcaacgggaccggccgccgccgguga

SEQ ID NO: 12672 - RNA, 1614 nt, Artificial Sequence
  derived and/or modified sequence opt1 from VP1__Norovirus_and/or_Norovirus-like__KF806519
augaagauggccagcaacgacgccucccccagcgacggcuccgcggccaaccuggugccggaggucaacaacgaggugauggcccucgagcccguggucggggccaccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggccaacaacgcgggcgaggacguguucaccgucagcugccgcgugcugacccggccgucccccgacuucgacuucaucuuccucgugagccccaccgucgagucccgcagcaagcccuucacggugccgauccugaccguggaggagaugaccaacucccgguuccccaucccccuggagaagcuguucaccggccccagcggggccuucgucgugcagccgcagaacggccgcugcacgaccgacgggguccuccugggcaccacccagcucucccccgugaacaucugcacguuccggggcgaccugacccacuucaccgggaccagcgaguacgccaugaaccuggccucccagaacuggaacaacuacgaccccacggaggagaucccggcgccccucggcgcccccgacuucguggggaagauccgcggcaugcugacccagaccacccggcgcgacgggagcacgcggggccaccgcgccacccugagcaccggcuccgcccacuucacccccaagcucgggaacauccgguucagcacggacaccaacaacgacuucgaggccggccagaacaccaaguucaccccggucgggguguuccaggagggcgacaaccaccagaacgagccccagcagugggugcugcccaacuacuccggggccacggcgcacaacguccaccuggcccccgccguggccccggcguuccccggcgagcagcuccuguucuuccgcagcaccaugcccggcugcgggggcuaccccaacaugaaccuggacugccuccugccgcaggagugggugcagcacuucuaccaggaggccgcccccgcccaguccgacgucgcccugcuccgguucgugaaccccgacaccagccgcgugcuguucgagugcaagcugcacaaguccggguacgucaccguggcgcacacgggccagcacgaccucgugaucccgcccaacggguacuuccgguucgacagcugggucaaccaguucuacacccuggcccccaugggcaacggcaccgggcgccgccgguga

SEQ ID NO: 12673 - RNA, 1614 nt, Artificial Sequence
  derived and/or modified sequence opt1 from VP1__Norovirus_and/or_Norovirus-like__AB303924
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccguguucugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacgugacccacaucgccggcucccacgacuacaccaugaaccuggccagccagaacuggaacaacuacgaccccaccgaggagauccccgcgccgcuggggacgcccgacuucgugggcaagauccaggggaugcucacccagaccacccgcgaggacggcuccacgcgggcccacaaggccaccgucagcaccgggagcgugcacuucacccccaagcugggcuccgugcaguacacgaccgacaccaacaacgacuuccagaccggccagaacacgaaguucacccccgucggggugauccaggacggcaacaaccaccagaacgagccgcagcagugggugcugcccaacuacagcgggcgcaccggccacaacguccaccucgcccccgccguggcgcccaccuucccgggggagcagcugcuguucuuccgguccacgaugcccggcugcagcggcuaccccaacaugaaccucgacugccugcugccccaggagugggugcagcacuucuaccaggaggccgccccggcccaguccgacgucgcgcuccugcgcuucgugaaccccgacaccgggcgggugcuguucgagugcaagcuccacaagagcggcuacgucaccguggcccacaccgggccccacgaccuggugaucccgcccaacggcuacuuccgcuucgacuccugggucaaccaguucuacacccuggcccccauggggaacggcgccggccggcgccgguga

SEQ ID NO: 12674 - RNA, 1614 nt, Artificial Sequence
  derived and/or modified sequence opt1 from VP1__Norovirus_and/or_Norovirus-like__DQ975270
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcacguacaacggcuacgccgggggcuucgaggugcaggucauccucgccgggaacgccuucaccgcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccacgaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcaccaagcccuucaccguccccauccugaccguggaggagauguccaacagccgguuccccaucccccuggagaagcucuacacgggccccuccagcgccuucgugguccagccgcagaacgggcgcugcaccaccgacggcgugcugcuggggaccacgcagcucuccgccgucaacaucugcaccuuccggggcgacgugacccacaucgccggcagccacgacuacaccaugaaccuggccucccagaacuggaacaacuacgaccccacggaggagauccccgcgccgcuggggacccccgacuucgugggcaagauccaggggaugcucacccagaccacgcgcgaggacggcagcacccgggcccacaaggccaccgucagcaccggguccgugcacuucacgcccaagcugggcagcgugcaguacaccaccgacaccaacaacgacuuccagacgggccagaacaccaaguucacccccgucggggugauccaggacggcaacaaccaccagaacgagccgcagcagugggugcugcccaacuacuccgggcgcaccggccacaacguccaccucgcccccgccguggcgcccacguucccgggggagcagcugcuguucuuccggagcaccaugcccggcugcuccggcuaccccaacaugaaccucgacugccugcugccccaggagugggugcagcacuucuaccaggaggccgccccggcccagagcgacgucgcgcuccugcgcuucgugaaccccgacaccgggcgggugcuguucgagugcaagcuccacaaguccggcuacgucaccguggcccacaccgggccccacgaccuggugaucccgcccaacggcuacuuccgcuucgacagcugggucaaccaguucuacacgcuggcccccauggggaacggcgccggccggcgccgguga

SEQ ID NO: 12675 - RNA, 1614 nt, Artificial Sequence
  derived and/or modified sequence opt1 from VP1__Norovirus_and/or_Norovirus-like__AF414424
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugggccagcuggagcccgugcucaucccgcugcccgacguccggaacaacuucuaccacuacaaccagagcaacgacuccaccaucaagcugaucgccaugcucuacacgccccugcgcgccaacaacgcgggcgacgacguguucaccgugagcugccggguccugacccgccccuccccggacuucgacuucaucuuccucgugccgcccaccguggagagccggacgaagcccuucaccguccccauccugaccguggaggagauguccaacagccgcuuccccaucccccuggagaagcucuacaccgggcccuccagcgccuucgugguccagccgcagaacggccggugcacgaccgacggggugcugcugggcaccacccagcucuccgccgucaacaucugcacguuccgcggcgacgugacccacaucgccgggagccacgacuacaccaugaaccuggccucccagaacuggaacaacuacgaccccaccgaggagauccccgcgccgcugggcacgcccgacuucguggggaagauccagggcguccucacccagaccacccgggaggacgggagcacgcgcgcccacaaggccaccgugagcaccggcuccgugcacuucacccccaagcugggcagcguccaguacacgaccgacaccaacaacgacuuccagaccgggcagaacacgaaguucacccccgugggcgugauccaggacgggaacaaccaccagaacgagccgcagcaguggguccugcccaacuacuccggccggaccgggcacaacgugcaccucgcccccgccguggcgcccaccuucccgggcgagcagcugcuguucuuccgcagcacgaugcccggcugcuccggguaccccaacaugaaccucgacugccugcugccccaggaguggguccagcacuucuaccaggaggccgccccggcccagagcgacguggcgcuccugcgguucgugaaccccgacaccggccgcguccuguucgagugcaagcuccacaaguccggguacgugaccguggcccacaccggcccccacgaccuggucacgcccccgaacggguacuuccgguucgacagcugggugaaccaguucuacacccuggcccccaugggcaacggcgccgggcgccggcgcuga

SEQ ID NO: 12676 - RNA, 1614 nt, Artificial Sequence
  derived and/or modified sequence opt1 from VP1__Norovirus_and/or_Norovirus-like__LC048964
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcuccaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugagcaacucccgguuccccaucccccuggagaagcucuacaccggccccagcuccgccuucgugguccagccgcagaacgggcgcugcacgaccgacggcgugcugcuggggaccacccagcucagcgccgucaacaucugcacguuccggggcgacgugacccacaucgccggcucccacgacuacaccaugaaccuggccagccagaacuggaacaacuacgaccccaccgaggagauccccgcgccgcuggggacgcccgacuucgugggcaagaaccaggggcuccugagccagaccacccgcggcgacggguccacccgggcccacaaggccacggucagcaccggcuccgugcacuucacccccaagcugggcagcgugcaguacaccacggacaccaacaacgacuucgagaccgggcagaacaccaaguucacgcccgucggcgugauccaggacgggaacaaccaccagaacgagccgcagcagugggcccuccccaacuacuccggccgcaccgggcacaacgugcaccuggcccccgcggucgcccccaccuucccgggcgagcagcuccucuucuuccggagcaccaugcccggcugcuccggguaccccaacaugaaccuggacugccugcucccccaggagugggugcagcacuucuaccaggaggccgccccggcgcagagcgacguggcccugcugcgcuucgucaaccccgacacgggccgggugcuguucgagugcaagcugcacaaguccggguacgugaccgucgcccacaccggcccccacgaccuggugaucccgcccaacggguacuuccgcuucgacagcugggugaaccaguucuacacccucgcccccaugggcaacggcgccgggcggcgccgguga

SEQ ID NO: 12677 - RNA, 1614 nt, Artificial Sequence
  derived and/or modified sequence opt1 from VP1__Norovirus_and/or_Norovirus-like__AB684705
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugagcccggaccucaaccccuaccugucccaccugagccgcauguacaacggcuacgccggcggguucgagguccaggugauccucgccggcaacgccuucaccgccgggaaggugaucuucgccgccgugccgcccaacuucccgacggagggccugucccccagccaggugaccauguucccccacaucaucgucgacgugcggcagcuggagcccgugcucaucccgcugcccgacguccgcaacaacuucuaccacuacaaccagacccacgacuccacccugaagcucaucgccaugcuguacacgccccugcgggccaacaacgcgggggacgacguguucaccgugagcugccgcguccucacccggcccuccccggacuucgacuucaucuuccuggugccgcccaccguggagagccgcacgaagcccuucaccguccccauccugaccguggaggagauguccaacagccgguuccccaucccccucgagaagcuguacaccggccccuccagcgccuucgugguccagccgcagaacggccgcugcacgaccgacggggugcugcucggcaccacccagcuguccgccgucaacaucugcaacuuccgcggggacgugacgcgggugggcaucagccacgacuacaccaugaaccuggucagccagaacuggaacaacuacgaccccaccgaggagauccccgccccgcucggcacccccgacuucguggggaagauccagggccugcugacgcagaccacccgggccgacuccagcacccgcgcgcacaaggccacgcucuccaccgggagcgugcacuucacccccaagcugggcuccguccaguucaccacggacaccaacaacgacuuccagaccgggcagaacaccaaguucacgcccgugggcgugauccaggacagcgaccaccaccagaacgagccgcagcaguggguccugcccaacuacuccggcagcuccgggcacaacgugcaccucgcccccgccguggcccccaccuucccgggcgagcagcugcuguucuuccggagcaccaugcccgggugcuccggcuaccccaacaugaaccucgacugccugcugccccaggaguggguccuccacuucuaccaggaggcggccccggcccagagcgacguggcccugcugcgcuucgugaaccccgacaccgggcggguccucuucgagugcaagcugcacaaguccggcuacaucacgguggcgcacaccggccccuacgaccuggugaucccgcccaacggguacuuccgcuucgacagcugggucaaccaguucuacacccucgcccccaugggcaacgggaccggccggcgccgguga

SEQ ID NO: 12678 - RNA, 1614 nt, Artificial Sequence
  derived and/or modified sequence opt1 from VP1__Norovirus_and/or_Norovirus-like__KF806523
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugagccccaccgucgagucccgcagcaagcccuucaccgugccgauccugacgguggaggagaugaccaacucccgguuccccaucccccuggagaagcuguucaccggccccagcggggccuucgucgugcagccgcagaacggccgcugcaccacggacgggguccuccugggcaccacccagcucucccccgugaacaucugcaccuuccggggcgaccugacgcacuucaccgggaccagcgaguacgccaugaaccuggccucccagaacuggaacaacuacgaccccaccgaggagaucccggcgccccucggcgcccccgacuucguggggaagauccgcggcaugcugacgcagaccacccggcgcgacgggagcacccggggccaccgcgccacgcugagcaccggcuccgcccacuucacccccaagcucgggaacauccgguucagcaccgacacgaacaacgacuucgaggccggccagaacaccaaguucaccccggucgggguguuccaggagggcgacaaccaccagaacgagccccagcagugggugcugcccaacuacuccggggcgaccgcccacaacguccaccuggcccccgccguggcgccggccuuccccggcgagcagcuccuguucuuccgcagcacgaugcccggcugcgggggcuaccccaacaugaaccuggacugccuccugccgcaggagugggugcagcacuucuaccaggaggccgcccccgcccaguccgacgucgcgcugcuccgguucgugaaccccgacaccagccgcgugcuguucgagugcaagcugcacaaguccggguacgucaccguggcccacaccggccagcacgaccucgugaucccgcccaacggguacuuccgguucgacagcugggucaaccaguucuacacgcuggcccccaugggcaacggcaccgggcgccgccgguga

SEQ ID NO: 12679 - RNA, 1614 nt, Artificial Sequence
  derived and/or modified sequence opt1 from VP1__Norovirus_and/or_Norovirus-like__AY532129
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccacgggggcgaguucaccguguccccgcggaacgcccccggggagauccuguggagcgcgccccugggccccgaccucaacccguaccugucccaccuggcccgcauguacaacggcuacgccgggggcuucgaggugcaggucauccucgccgggaacgccuucacggcgggcaagaucaucuucgccgccgugccgcccaacuuccccaccgaggggcugagccccucccaggugaccauguucccccacaucaucgucgacgugcggcagcuggagcccgugcucaucccccugccggacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccucccccgacuucgacuucaucuuccucgugccgcccaccguggagagccgcacgaagcccuucaccguccccauccugaccguggaggagauguccaacagccgguucccgaucccccuggagaagcucuacaccggccccuccagcgccuucgugguccagccccagaacgggcgcugcacgaccgacggcgugcugcuggggaccacccagcucuccgccgucaacaucugcacguuccggggcgacgugacccacaucgccggcagccacgacuacaccaugaaccuggccucccagaacuggaacagcuacgacccgaccgaggagauccccgcgccccuggggacgccggacuucgugggcaagauccaggggaugcucacccagaccacccgcgaggacggcagcacgcgggcccacaaggccaccgucuccaccgggagcgugcacuucacccccaagcugggcuccgugcaguacacgaccgacaccaacaacgacuuccagaccggccagaacacgaaguucacccccgucggggugauccaggacggcaacaaccaccagaacgagccccagcagugggugcugccgaacuacagcgggcgcaccggccacaacguccaccucgcccccgccguggcgcccaccuuccccggggagcagcugcuguucuuccgguccacgaugccgggcugcagcggcuaccccaacaugaaccucgacugccugcugccccaggagugggugcagcacuucuaccaggaggccgcccccgcccaguccgacgucgcgcuccugcgcuucgugaacccggacaccgggcgggugcuguucgagugcaagcuccacaagagcggcuacgucaccguggcccacaccgggccccacgaccuggugaucccgcccaacggcuacuuccgcuucgacuccugggucaaccaguucuacacccuggcccccauggggaacggcgccggccggcgccgguga

SEQ ID NO: 12680 - RNA, 1614 nt, Artificial Sequence
  derived and/or modified sequence opt1 from VP1__Norovirus_and/or_Norovirus-like__AY532124
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgcccggaacgccuucacggcggggaaggugaucuucgccgccgugccgcccaacuucccgaccgagggccugagccccucccaggucaccauguucccccacaucaucguggacgugcgccagcuggagcccguccucaucccgcugcccgacgugcggaacaacuucuaccacuacaaccagagcaacgacuccaccaucaagcugaucgccaugcucuacacgccccugcgcgccaacaacgcgggggacgacguguucaccgucagcugccgggugcugacccgccccuccccggacuucgacuucaucuuccucgugccgcccaccgucgagagccggacgaagcccuucaccgugcccauccugaccguggaggagauguccaacagccgcuuccccaucccccuggagaagcucuacaccggccccuccagcgccuucgucgugcagccgcagaacggccggugcacgaccgacgggguccugcugggcaccacccagcucuccgccgugaacaucugcacguuccgcggggacgugacccacaucgccggcagccacgacuacaccaugaaccuggccucccagaacuggaacaacuacgaccccaccgaggagauccccgcgccgcugggcacgcccgacuucgucgggaagauccagggcaugcucacccagaccacccgggaggacgggagcacgcgcgcccacaaggccaccgugagcaccggcuccgugcacuucacccccaagcuggggagcguccaguacacgaccgacaccaacaacgacuuccagaccggccagaacacgaaguucacccccgugggcgugauccaggacgggaacaaccaccagaacgagccgcagcaguggguccugcccaacuacuccggccggaccgggcacaacgugcaccucgcccccgccguggcgcccaccuucccgggcgagcagcugcuguucuuccgcagcacgaugcccgggugcuccggcuaccccaacaugaaccucgacugccugcugccccaggaguggguccagcacuucuaccaggaggccgccccggcccagagcgacguggcgcuccugcgguucgugaaccccgacaccggccgcguccuguucgagugcaagcuccacaaguccggguacgugaccguggcccacaccggcccccacgaccuggucaucccgcccaacggguacuuccgguucgacagcugggugaaccaguucuacacccuggcccccaugggcaacggggccggccgccggcgcuga

SEQ ID NO: 12681 - RNA, 1614 nt, Artificial Sequence
  derived and/or modified sequence opt1 from VP1__Norovirus_and/or_Norovirus-like__KX514309
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcaccaagcccuucuccguccccauccugacggugggcgagaugaccaacagccgguuccccaucaaccuggagcgccucuucaccgggcccuccagcgccaacgugguccagccgcagaacggccggugcaccaucgacggggagcugcugggcacgacccagcucuccagcgugaacaucugcaccuuccgcggcgacgucacccaccccgggggcuccaagaucuacacgaugaaccuggccagccccaacuggaacaacuacgacccgaccgaggagauccccgcgccccuggggacccccgacuucgugggcaagauccacgggaugcucacccagacgaccaagggcgagggcagcacccgggggcaccgcgccaccguguacgucggcggggccaacuucacgccgaagcugggcaaggugcaguucgagaccgacaccggggacgaccuggccauccggcagaacaccaaguucacgcccgugggcgucauccaguccagcgaccaccaccgcgacgagccccagcaguggcggcuccccaacuacuccggcgccaacaccuucaacgugcaccuggccccggccguggcgcccaacuuccccggggagcagcuccuguucuuccgcagcacccugcccggcugcgggggccacccgaacauggaccuggacugccuccugccccaggaguggguccagcacuucuaccaggaggccgcccccgcccaguccgacguggcgcugcuccgguucgugaaccccgacaccagccgcguccuguucgagugcaagcugcacaaguccggguacgugacgguggcccacaccggccagcacgaccucgucaucccgcccaacggcuacuuccgguucgacagcugggugaaccaguucuacacccuggcccccauggggaacggcaccgggcgcaagcgcuga

SEQ ID NO: 12682 - RNA, 1614 nt, Artificial Sequence
  derived and/or modified sequence opt1 from VP1__Norovirus_and/or_Norovirus-like__KX514308
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggacaagcuguucaccgggcccagcuccgcgaacgugguccagccgcagaacggccgcugcacgaucgacggggagcugcugggcaccacccagcucagcuccgugaacaucugcaccuuccggggcgacgucacgcacaucgggagcacccgccacuggaccaugaaccuggccagccccaacuggaacaacuacgaccccaccgaggagacgccggcgccccugggcacccccgacuucguggggaagauccacggcaugcucacccagaccacgcaggagaacggguccacccgggcccaccgcgccaccguguacgucggcagcgccgacuucacccccaagcugggcaaggugcaguucgagacggacaccgaggacgaccuggccauccggcagaacaccaaguucaccccggugggggucauccaguccagcgaccaccaccgcgacgagccccagcaguggcggcuccccaacuacuccggcgccaacacguucaacgugcaccuggcccccgccguggcgccgaacuuccccggggagcagcuccucuucuuccgcagcacccugcccggcugcgggggccaccccaacauggaccuggacugccuccugccgcaggaguggguccagcacuucuaccaggaggccgcccccgcccaguccgacguggcgcugcuccgguucgugaaccccgacaccagccgcguccuguucgagugcaagcugcacaaguccggcuacgugaccguggcccacacggggcaguacgaccucguccugcccagcaacggcuacuuccgguucgacuccugggugaaccaguucuacacccuggccccgauggggaacggcaccgggcgccgccgguga

SEQ ID NO: 12683 - RNA, 1614 nt, Artificial Sequence
  derived and/or modified sequence opt1 from VP1__Norovirus_and/or_Norovirus-like__KX514283
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaaggacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgucacccuggacaagcuguucaccggccccagcuccaccaucgugguccagccccagaacgggcgcugcaugaucgacggcgugcugcuggggacgacccagcucagcccggugaacaucugcaccuuccggggcgacgucacccacccccgcgacuccacgaucuacaccaugaaccuggccagccccaacuggaacaacuacgacccgaccgaggagauccccgcgccccugggcacccccgacuucacggggaagauccagggcaugcucacccagaccaccaagggggagggcagcacgcgggggcaccgcgccaccguguacgugggcuccgccgaguucaccccgaagcugggcaagguccgguucgagaccgacacggaggacgaccuggugauccgccagaacaccaaguucacccccgugggggucauccagagcuccgaccaccaccgggacgagccccagcaguggcgccuccccaacuacagcggcgccaacaccuucaacgugcaccuggccccggccguggcccccaacuuccccggggagcagcuccucuucuuccgguccacgcugcccggcugcgggggccacccgaacauggaccuggacugccuccugccccaggaguggguccagcacuucuaccaggaggcggcccccgcccagagcgacguggcccugcuccgcuucgugaaccccgacaccucccggguccuguucgagugcaagcugcacaagagcggcuacgugaccguggcgcacaccgggcaguacgaccucguccugccguccaacggcuacuuccgcuucgacagcugggugaaccaguucuacacgcuggcccccauggggaacggcaccgggcgccggcgcuga

SEQ ID NO: 12684 - RNA, 1614 nt, Artificial Sequence
  derived and/or modified sequence opt1 from VP1__Norovirus_and/or_Norovirus-like__KX514194
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcaggggaacggcuccacccggggccaccgcgccaccguguacgucgggagcgccgaguucacccccaagcugggcaaggugcaguucaagacggagaccgaccacgaccuggccauccggcagaacaccaaguucaccccggugggggucauccaggaguccgaccaccaccgcgacgagccccagcaguggcggcuccccaacuacagcggcgccaacacguucaacgugcaccuggcccccgccguggcgccgaacuuccccggggagcagcuccuguucuuccgcuccacccugcccggcugcggcgggcaccccaacauggaccuggacugccuccugccgcaggaguggguccagcacuucuaccaggaggccgcccccgcccagagcgacguggcgcugcuccgguucgugaaccccgacaccucccgcguccuguucgagugcaagcugcacaagagcggcuacgugaccguggcccacacggggcaguacgaccucguccugcccuccaacggcuacuuccgguucgacagcugggugaaccaguucuacacccuggccccgauggggaacggcaccggccgccgccgguga

SEQ ID NO: 12685 - RNA, 1614 nt, Artificial Sequence
  derived and/or modified sequence opt1 from VP1__Norovirus_and/or_Norovirus-like__KY424340
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagccacgacuccacccugaagcucaucgccaugcuguacacgccccugcgggccaacaacgcgggcgacgacguguucaccgugagcugccgcguccucacccggcccuccccggacuucgacuucaucuuccuggugccgcccaccguggagagccgcaccaagcccuucacgguccccauccugaccguggaggagauguccaacagccgguuccccaucccccucgagaagcuguacaccggccccuccagcgccuucgugguccagccgcagaacgggcgcugcaccacggacggcgugcugcucgggaccacccagcuguccgccgucaacaucugcaacuuccggggcgacgugacccacaucgugggcagccacgacuacacgaugaaccuggccagccagaacugguccaacuacgaccccaccgaggagauccccgccccgcucgggacccccgacuucgucggcaagauccaggggcugcugacccagacgacccgcgcggacggcagcacccgggcccacaaggccaccguguccacggggagcgugcacuucacccccaagcucggcuccguccaguucaccaccgacacgaacaacgacuuccagaccggccagaacaccaaguucacccccgugggggugauccaggacggcgaccaccaccagaacgagccgcagcaguggguccugcccaacuacagcgggcgcacgggccacaacgugcaccuggcccccgccguggcgcccaccuucccgggggagcagcuccuguucuuccgguccaccaugcccggcugcagcggcuaccccaacaugaaccuggacugccuccugccccaggaguggguccugcacuucuaccaggaggccgccccggcccaguccgacguggcgcuccugcgcuucgugaaccccgacaccgggcggguccuguucgagugcaagcuccacaagagcggcuacaucacgguggcccacaccgggcccuacgaccuggugaucccgcccaacggcuacuuccgcuucgacuccugggucaaccaguucuacacccuggcccccauggggaacggcaccggccggcgccgguga

SEQ ID NO: 12686 - RNA, 1614 nt, Artificial Sequence
  derived and/or modified sequence opt1 from VP1__Norovirus_and/or_Norovirus-like__LC016606
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcuccuggggaccacgcagcucucccccgucaacaucugcaccuuccggggcgacgugacccacaucagcggcacccacacguaccgcaugaaccuggccucccagaacuggaacaacuacgaccccaccgaggagaucccggcgccccuggggacccccgacuucgugggcaagauccaggggaugcucacccagacgaccaagggcgacgggagcacccggggccacaaggccaccgucagcacgggcuccguggacuucacccccaagcuggggagcgugcaguucgccaccgacaccaacaacgacuucgagacgggccagaacacccgcuucaccccggucggggugauccaggacggcuccgcccaccggaacgagccccagcagugggugcugcccgacuacagcgggaagaccguccacaacgugcaccucgcccccgccguggccccgacguuccccggcgagcagcugcuguucuuccgcuccaccaugcccggcugcagcggguaccccaacauggaccucgacugccugcugccgcaggaguggguccagcacuucuaccaggaggcggcccccgcccaguccgacguggcccuccugcgguucgugaaccccgacaccggccgcguccuguucgagugcaagcuccacaagaccggguacgugaccguggcgcacacgggccagcacgaccuggucaucccgcccaacggguacuuccgguucgacagcugggugaaccaguucuacacccuggcccccaugggcaacggcgccgggcgccggcgcuga

SEQ ID NO: 12687 - RNA, 1614 nt, Artificial Sequence
  derived and/or modified sequence opt1 from VP1__Norovirus_and/or_Norovirus-like__FJ537136
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagccacgacuccacccugaagcucaucgccaugcuguacacgccccugcgggccaacaacgcgggcgacgacguguucaccgugagcugccgcguccucacccggcccuccccggacuucgacuucaucuuccuggugccgcccaccguggagagccgcaccaagcccuucacgguccccauccugaccguggaggagauguccaacagccgguuccccaucccccucgagaagcuguacaccggccccuccagcgccuucgugguccagccgcagaacgggcgcugcaccacggacggcgugcugcucgggaccacccagcuguccgccgucaacaucugcaacuuccggggcgacgugacccacaucgugggcagccacgacuacacgaugaaccuggucagccagaacugguccaacuacgaccccaccgaggagauccccgccccgcucgggacccccgacuucgugggcaagauccaggggcugcugacccagacgacccgcgccgacggcagcacccgggcgcacaaggccaccguguccacggggagcguccacuucacccccaagcucggcuccgugcaguucaccaccgacacgaacaacgacuuccagaccggccagaacaccaaguucacccccgugggggucauccaggacggcgaccaccaccagaacgagccgcagcagugggugcugcccaacuacagcgggcgcacgggccacaacgugcaccuggcccccgccgucgcccccaccuucccgggggagcagcuccuguucuuccgguccaccaugcccggcugcagcggcuaccccaacaugaaccuggacugccuccugccccaggagugggugcugcacuucuaccaggaggcggccccggcccaguccgacguggcccuccugcgcuucgucaaccccgacaccgggcgggugcuguucgagugcaagcuccacaagagcggcuacaucacgguggcgcacaccgggcccuacgaccuggucaucccgcccaacggcuacuuccgcuucgacuccugggugaaccaguucuacacccuggcccccauggggaacggcaccggccggcgccgguga

SEQ ID NO: 12688 - RNA, 1614 nt, Artificial Sequence
  derived and/or modified sequence opt1 from VP1__Norovirus_and/or_Norovirus-like__AY532117
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccuggggccguggggcgaguucaccgugagcccccggaacgcccccggggagauccugugguccgcgccccucggcccggaccugaaccccuaccugucccaccucgcccgcauguacaacggcuacgccgggggcuucgaggugcaggucauccuggccgggaacgccuucacggccggcaagaucaucuucgcggccgugccgcccaacuuccccaccgaggggcugagccccucccaggugaccauguucccccacaucaucgucgacgugcggcagcucgagcccgugcugaucccgcugcccgacguccgcaacaacuucuaccacuacaaccagagcaacgacuccaccaucaagcucaucgccaugcuguacacgccccugcgggccaacaacgccggcgacgacguguucaccgugagcugccgcguccucacccggcccuccccggacuucgacuucaucuuccuggugccgcccaccguggagagccgcacgaagcccuucaccguccccauccugaccguggaggagauguccaacagccgguuccccaucccccucgagaagcuguacaccggccccuccagcgcguucgugguccagccgcagaacgggcgcugcacgaccgacggcgugcugcucgggaccacccagcuguccgccgucaacaucugcacguuccggggcgacgugacccacaucgccggcagccacgacuacaccaugaaccuggccucccagaacuggaacaacuacgaccccaccgaggagauccccgccccgcucgggacgcccgacuucgugggcaagauccaggggguccugacccagaccacccgcgaggacggcagcacgcgggcgcacaaggccaccgugagcaccggguccgugcacuucacccccaagcugggcagcguccaguacacgaccgacaccuccaacgacuuccagaccggccagaacacgaaguucacccccgugggggugauccaggacggcaacaaccaccagaacgagccgcagcaguggguccuccccaacuacagcgggcgcaccggccacaacgugcaccuggcccccgccguggcccccaccuucccgggggagcagcuccuguucuuccgguccacgaugcccggcugcagcggcuaccccaacaugaaccuggacugccugcucccccaggaguggguccagcacuucuaccaggaggcggccccggcccaguccgacguggcccugcugcgcuucgugaaccccgacaccgggcggguccucuucgagugcaagcugcacaagagcggcuacgugaccguggcgcacaccgggcccuacgaccuggucaucccgcccaacggcuacuuccgcuucgacuccugggugaaccaguucuacacccucgcccccauggggaacggcgccggccggcgccgguga

SEQ ID NO: 12689 - RNA, 1614 nt, Artificial Sequence
  derived and/or modified sequence opt1 from VP1__Norovirus_and/or_Norovirus-like__KX514279
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccaucaaccuggagcgccucuucaccgggcccuccagcgccaacgugguccagccgcagaacggccggugcacgaucgacggggagcugcugggcaccacccagcucuccagcgugaacaucugcaccuuccgcggcgacgucacgcagaucggguccacccaccacuggaccaugaaccuggccagccccaacuggaacaacuacgaccccaccgaggagacgccggcgccccugggcacccccgacuucguggggaagauccacggcaugcucacccagaccacgcaggagaacgggagcacccgggcccaccgcgccaccguguacgucggcuccgccgacuucacccccaagcugggcaaggugcaguucgagacggacaccgaggacgaccuggccauccggcagaacaccaaguucaccccggugggggucauccagagcuccgaccaccaccgcgacgagccccagcaguggcggcuccccaacuacagcggcgccaacacguucaacgugcaccuggcccccgcgguggccccgaacuuccccggggagcagcuccuguucuuccgcuccacccugcccggcugcgggggccaccccaacauggaccuggacugccuccugccgcaggaguggguccagcacuucuaccaggaggccgcccccgcgcagagcgacguggcccugcuccgguucgugaaccccgacaccucccgcguccuguucgagugcaagcugcacaagagcggcuacgugaccguggcccacacggggcaguacgaccucguccugcccuccaacggcuacuuccgguucgacagcugggugaaccaguucuacacccuggccccgauggggaacggcaccgggcgccgccgguga

SEQ ID NO: 12690 - RNA, 1614 nt, Artificial Sequence
  derived and/or modified sequence opt1 from VP1__Norovirus_and/or_Norovirus-like__LC016602
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcugcuggggaccacgcagcucucccccgucaacaucugcaccuuccggggcgacgugacccacaucagcggcaccuccacguaccgcaugaaccuggccagccagaacuggaacaacuacgaccccaccgaggagaucccggcgccccuggggacccccgacuucgugggcaagauccaggggaugcucacccagacgaccaagggcgacgggagcacccggggccacaaggccaccgucuccacgggcagcguggacuucacccccaagcugggguccgugcaguucgacaccgacaccaacaacgaccuggagacgggccagaacacccgcuucaccccggucggggugauccaggacggcagcgcccaccggaacgagccccagcagugggugcuccccgacuacuccgggcgcaccguccacaacgugcaccuggcccccgccguggccccgacguuccccggcgagcagcuccucuucuuccggagcaccaugcccggcugcuccggguaccccaacauggaccuggacugccugcucccgcaggaguggguccagcacuucuaccaggaggccgcgcccgcccagagcgacguggcccugcugcgcuucgugaaccccgacaccggccggguccucuucgagugcaagcugcacaagaccggguacgugaccguggcccacacgggccagcacgaccuggucaucccgcccaacggguacuuccgcuucgacuccugggugaaccaguucuacacccucgcgcccaugggcaacggcgccgggcggcgccgcuga

SEQ ID NO: 12691 - RNA, 1614 nt, Artificial Sequence
  derived and/or modified sequence opt1 from VP1__Norovirus_and/or_Norovirus-like__AF145896
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagccacgacuccacccugaagcucaucgccaugcuguacacgccccugcgggccaacaacgcgggcgacgacguguucaccgugagcugccgcguccucacccggcccuccccggacuucgacuucaucuuccuggugccgcccaccguggagagccgcaccaagcccuucacgguccccauccugaccguggaggagauguccaacagccgguuccccaucccccucgagaagcuguacaccggccccuccagcgccuucgugguccagccgcagaacgggcgcugcaccacggacggcgugcugcucgggaccacccagcuguccgccgucaacaucugcaacuuccggggcgacgugacccacaucgugggcagccacgacuacacgaugaaccuggccagccagaacugguccaacuacgaccccaccgaggagauccccgccccgcucgggacccccgacuucgucggcaagauccaggggcugcugacccagacgacccgcgcggacggcagcacccgggcccacaaggccaccguguccacggggagcgugcacuucacccccaagcucggcuccguccaguucaccaccgacacgaacaacgacuuccagaccggccagaacaccaaguucacccccgugggggugauccaggacggcgaccaccaccagaacgagccgcagcaguggguccugcccaacuacagcgggcgcacgggccacaacgugcaccuggcccccgccguggcgcccaccuucccgggggagcagcuccuguucuuccgguccaccaugcccggcugcagcggcuaccccaacaugaaccuggacugccuccugccccaggaguggguccugcacuucuaccaggaggccgccccggcccaguccgacguggcgcuccugcgcuucgugaaccccgacaccgggcggguccuguucgagugcaagcuccacaagagcggcuacaucacgguggcccacaccgggcccuucgaccuggugaucccgcccaacggcuacuuccgcuucgacuccugggucaaccaguucuacacccuggcccccauggggaacggcaccggccggcgccgguga

SEQ ID NO: 12692 - RNA, 1614 nt, Artificial Sequence
  derived and/or modified sequence opt1 from VP1__Norovirus_and/or_Norovirus-like__AB684704
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugagcccggaccucaaccccuaccugucccaccugagccgcauguacaacggcuacgccggcggguucgagguccaggugauccucgccggcaacgccuucaccgccgggaaggugaucuucgccgccgugccgcccaacuucccgacggagggccugucccccagccaggugaccauguucccccacaucaucgucgacgugcggcagcuggagcccgugcucaucccgcugcccgacguccgcaacaacuucuaccacuacaaccaggcccacgacuccacccugaagcucaucgccaugcuguacacgccccugcgggcgaacaacgccggggacgacguguucaccgugagcugccgcguccucacccggcccuccccggacuucgacuucaucuuccuggugccgcccaccguggagagccgcaccaagcccuucacgguccccauccugaccguggaggagauguccaacagcaaguuccccaucccccucgagaagcuguacaccggccccuccagcgccuucgugguccagccgcagaacggccggugcaccacggacggggugcugcucggcaccacccagcuguccgccgucaacaucugcaacuuccgcggggacgugacccgggugggcacgagccacgacuacaccaugaaccuggucagccagaacuggaacaacuacgaccccaccgaggagauccccgccccgcucggcacccccgacuucguggggaagauccagggccugcugacgcagaccacccgcgcggacggguccacccgggcccacaaggccacggugagcaccggcuccguccacuucacccccaagcucgggagcgugcaguucaccacggacaccaacaacgacuucgagaccggccagaacaccaaguucacgcccgugggcgucauccaggacggggaccaccaccagaacgagccgcagcagugggugcugcccuccuacagcggcuccagcgggcacaacgugcaccuggcccccgccgucgcgcccaccuucccgggcgagcagcuccuguucuuccgcuccaccaugcccgggugcagcggcuaccccaacaugaaccuggacugccuccugccccaggagugggugcugcacuucuaccaggaggccgccccggcccaguccgacguggcgcuccugcgguucgucaaccccgacaccggccgcgugcuguucgagugcaagcuccacaagagcggguacaucacgguggcccacaccggccccuacgaccuggucaucccgcccaacggguacuuccgguucgacuccugggugaaccaguucuacacccuggcccccaugggcaacgggaccggccgccggcgcuga

SEQ ID NO: 12693 - RNA, 1614 nt, Artificial Sequence
  derived and/or modified sequence opt1 from VP1__Norovirus_and/or_Norovirus-like__JX401279
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccaggcccacgacagcacccugaagcucaucgccaugcuguacacgccccugcgggcgaacaacgccggcgacgacguguucaccguguccugccgcguccucacccggcccagcccggacuucgacuucaucuuccuggugccgcccaccguggagucccgcaccaagcccuucacgguccccauccugaccguggaggagaugagcaacucccgguuccccaucccccucgagaagcuguacaccggccccagcuccgccuucgugguccagccgcagaacgggcgcugcaccacggacggcgugcugcucgggaccacccagcugagcgccgucaacaucugcaacuuccggggcgacgugacccgcgugggcacgucccacgacuacaccaugaaccuggucagccagaacuggaacaacuacgaccccaccgaggagauccccgccccgcucgggacccccgacuucgugggcaagauccaggggcugcugacgcagaccacccgggcggacggcagcacccgcgcccacaaggccacgguguccaccgggagcguccacuucacccccaagcucggcuccgugcaguucaccacggacaccgacaacgacuuccagaccggccagaacaccaaguucacgcccgugggggucauccaggacggcgaccaccaccagaacgagccgcagcagugggugcugcccaacuacagcgggaccuccggccacaacgugcaccuggcccccgccgucgcgcccgccuucccgggggagcagcuccuguucuuccggagcaccaugcccggcugcuccggcuaccccaacaugaaccuggacugccuccugccccaggagugggugcugcacuucuaccaggaggccgccccggcgcagagcgacguggcccuccugcgcuucgucaaccccgacaccgggcgggugcuguucgagugcaagcuccacaaguccggcuacaucacgguggcccacaccgggcccuacgaccuggucaucccgcccaacggcuacuuccgcuucgacagcugggugaaccaguucuacacccuggcccccauggggaacggcaccggccggcgccgguga

SEQ ID NO: 12694 - RNA, 1614 nt, Artificial Sequence
  derived and/or modified sequence opt1 from VP1__Norovirus_and/or_Norovirus-like__GQ389627
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccggccccuccagcgccuucgugguccagccgcagaacgggcgcugcacgaccgacggcgugcugcuggggaccacccagcucuccgccgucaacaucugcacguuccggggcgacgugacccacaucgccggcagccacgacuacaccaugaaccuggccucccagaacuggagcaacuacgaccccaccgaggagauccccgcgccgcuggggacgcccgacuucgugggcaagauccaggggaugcucacccagaccacccgcgaggacggcagcacgcgggcccacaaggccaccgucuccaccgggagcgugcacuucacccccaagcugggcuccgugcaguacacgaccgacaccaacaacgacuuccagaccggccagaacacgaaguucacccccgucggggugauccaggacggcaacaaccaccagaacgagccgcagcagugggugcugcccaacuacagcgggcgcaccggccacaacguccaccucgcccccgccguggcgcccaccuucccgggggagcagcugcuguucuuccgguccacgaugcccggcugcagcggcuaccccaacaugaaccucgacugccugcugccccaggagugggugcagcacuucugccaggaggccgccccggcccaguccgacgucgcgcuccugcgcuucgugaaccccgacaccgggcgggugcuguucgagugcaagcuccacaagagcggcuacgucaccguggcccacaccgggccccacgaccuggugaucccgcccaacggcuacuuccgcuucgacuccugggucaaccaguucuacacccuggcccccauggggaacggcgccggccggcgccgguga

SEQ ID NO: 12695 - RNA, 1614 nt, Artificial Sequence
  derived and/or modified sequence opt1 from VP1__Norovirus_and/or_Norovirus-like__AF425763
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggccccgcgcggggaguucaccgugagcccccggaacgcccccggcgagauccugugguccgcgccccuggggccggaccucaaccccuaccugucccaccuggcccggauguacaacggcuacgccggcggguucgaggugcaggucauccucgccggcaacgccuucacggcggggaagaucaucuucgccgccgugccgcccaacuuccccaccgagggccugagccccucccaggugaccauguucccccacaucaucgucgacgugcgccagcuggagcccgugcucaucccgcugcccgacguccggaacaacuucuaccacuacaaccagagcaacgacuccaccaucaagcugaucgccaugcccuacacgccccuccgcgccaacaacgcgggggacgacguguucaccgugagcugccggguccugacccgcccgucccccgacuucgacuucaucuuccuggugccgcccaccguggagagccggacgaagcccuucaccguccccauccucaccguggaggagauguccaacagccgcuuccccaucccccuggagaagcuguacaccggcccguccagcgccuucgugguccagccccagaacggccggugcacgaccgacggggugcuccugggcaccacccagcuguccgccgucaacaucugcacguuccgcggggacgugacccacaucgccggcagccacgacuacaccaugaaccucgccucccagaacuggaacaacuacgaccccaccgaggagaucccggcgccccugggcacgcccgacuucguggggaagauccagggcaugcugacccagaccacccgggaggacgggagcacgcgcgcccacaaggccaccgucagcaccggcuccgugcacuucacgccccggcucgggagcgugcaguacaccaccgacaccaacaacgacuuccagaccggccagaacacgaaguucaccccggucggcgugauccaggacgggaacaaccaccagaacgagccccagcagugggugcugcccaacuacuccggccgcaccgggcacaacguccaccuggcccccgccguggcgccgaccuuccccggcgagcagcuccuguucuuccggagcacgaugcccgggugcuccggcuaccccaacaugaaccuggacugccuccugccgcaggagugggugcagcacuucuaccaggaggccgcccccgcccagagcgacgucgcgcugcuccgcuucgugaaccccgacaccggccgggugcuguucgagugcaagcugcacaaguccggguacgucaccguggcccacaccggcccccacgaccucgugaucccgcccaacggguacuuccgcuucgacagcugggucaaccaguucuacacccuggcccccaugggcaacggggccggccggcgccgcuga

SEQ ID NO: 12696 - RNA, 1614 nt, Artificial Sequence
  derived and/or modified sequence opt1 from VP1__Norovirus_and/or_Norovirus-like__AY532127
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacggccgcaacaacuucuaccacuacaaccagagcaacgacuccaccaucaagcugaucgccaugcucuacacgccccugcgggccaacaacgcgggcgacgacgucuucaccgugagcugccgcgugcugacccggcccuccccggacuucgacuucaucuuccucgucccgcccaccguggagagccgcacgaagcccuucaccgugcccauccugaccgucgaggagauguccaacagccgguuccccaucccccuggagaagcucuacaccgggcccuccagcgccuucguggugcagccgcagaacggccgcugcacgaccgacgggguccugcugggcaccacccagcucuccgccgugaacaucugcacguuccggggcgacgucacccacaucgccgggagccacgacuacaccaugaaccuggccucccagaacuggaacaacuacgaccccaccgaggagauccccgcgccgcugggcacgcccgacuucguggggaagauccagggcacccucacccagaccacgcgcgaggacgggagcacccgggcccacaaggccaccgugagcaccggcuccguccacuucacgcccaagcugggcagcgcccaguacaccaccgacaccaacaacgacuuccagacggggcagaacaccaaguucacccccgugggcgugauccaggacgggaacaaccaccagaacgagccgcagcaguggguccugcccaacuacuccggccgcaccgggcacaacgugcaccucgcccccgcgguggcccccacguucccgggcgagcagcugcuguucuuccggagcaccaugcccggcugcuccggguaccccaacaugaaccucgacugccugcugccccaggaguggguccagcacuucuaccaggaggccgccccggcgcagagcgacguggcccuccugcgcuucgugaaccccgacaccggccggguccuguucgagugcaagcuccacaaguccggguacgugaccguggcccacaccggcccccacgaccuggucaucccgcccaacggguacuuccgcuucgacagcugggugaaccaguucuacacgcuggcccccaugggcaacggcgccgggcggcgccgguga

SEQ ID NO: 12697 - RNA, 1614 nt, Artificial Sequence
  derived and/or modified sequence opt1 from VP1__Norovirus_and/or_Norovirus-like__AY532118
augaagauggccagcaacgacgccaaccccuccgacggcagcaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucacggcgggcaagaucaucuucgccgccgugccgcccaacuucccgaccgaggggcugggccccagccaggugaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggccaacaacgcgggcgacgacgucuucaccguguccugccgcgugcugacccggcccagcccggacuucgacuucaucuuccucgucccgcccaccguggagucccgcacgaagcccuucaccgugcccauccugaccgucgaggagaugagcaacucccgguuccccgugccccuggagaagcucuacaccgggcccagcuccgccuucgugguccagccgcagaacggccgcugcacgaccgacggggugcugcugggcaccacccagcucagcgccgucaacaucugcacguuccggggcgacgugacccacaucgccgggucccgcgacuacaccaugaaccuggccagccagaacuggaacaacuacgaccccaccgaggagauccccgcgccgcugggcacgcccgacuucguggggaagauccagggcguccucacccagaccacccgggaggacggguccacgcgcgcccacaaggccaccgugagcaccggcagcgugcacuucacccccaagcugggcuccguccaguacacgaccgacaccgacaacgacuuccagaccgggcagaacacgaaguucacccccgugggcgugauccaggacgggaacaaccaccagaacgagccgcagcaguggguccugcccaacuacagcggccggcccgggcacaacgugcaccucgcccccgccguggcgccgaccuuccugggcgagcagcuccuguucuuccgcuccaccaugcccggcugcagcggguaccccaacaugaaccuggacugccugcucccccaggaguggguccagcacuucuaccaggaggccgccccggcccaguccgacguggcgcugcugcgguucgugaaccccgacacgggccgcguccucuucgagugcaagcugcacaagagcggguacgugaccguggcccacaccggcccccacgaccuggucaucccgcccaacggguacuuccgguucgacuccugggugaaccaguucuacacccucgcccccaugggcaacggcgccgggcgccggcgcuga

SEQ ID NO: 12698 - RNA, 1614 nt, Artificial Sequence
  derived and/or modified sequence opt1 from VP1__Norovirus_and/or_Norovirus-like__KX514326
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcaccaagcccuucuccguccccauccugacggugggcgagaugaccaacagccgguuccccaucaaccuggagcgccucuucaccgggcccuccagcgccaacgugguccagccgcagaacggccggugcaccaucgacggggagcugcugggcacgacccagcucuccagcgugaacaucugcaccuuccgcggcgacgucacccagaucggguccacgaagcacuggaccaugaaccuggccagccccaacuggaacaacuacgaccccaccgaggagaccccggcgccccugggcacgcccgacuucguggggaagauccacggcaugcucacccagaccacccaggagaacgggagcacgcgggcccaccgcgccaccguguacgucggcggcgccaacuucacccccaagcuggggaaggugcaguucgagaccgacacgguggacgaccuggagauccggcagaacaccaaguucaccccggucggcgugauccaguccagcgaccaccaccgcgacgagccccagcaguggcggcuccccaacuacuccggggccaacaccuucaacgugcaccuggcccccgccgucgcgccgaacuuccccggcgagcagcuccuguucuuccgcagcacgcugcccgggugcggcggccaccccaacauggaccuggacugccuccugccgcaggagugggugcagcacuucuaccaggaggccgcccccgcccaguccgacguggcgcugcuccgguucgucaaccccgacaccagccgcgugcuguucgagugcaagcugcacaaguccggguacgugaccgucgcccacaccggccaguacgaccucgugcugcccagcaacggguacuuccgguucgacuccugggugaaccaguucuacacgcuggccccgaugggcaacgggaccggccgccgccgguga

SEQ ID NO: 12699 - RNA, 1614 nt, Artificial Sequence
  derived and/or modified sequence opt1 from VP1__Norovirus_and/or_Norovirus-like__KX514264
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcaccaagcccuucuccguccccauccugacggugggcgagaugaccaacagccgguuccccgugaaccuggagcgccucuucaccgggcccuccagcgccaacgucgugcagccgcagaacggccggugcaccaucgacggggagcugcugggcacgacccagcucuccagcgucaacaucugcaccuuccgcggcgacgugacccacaucggguccacgcaccacuggaccaugaaccuggccagccccaacuggaacaacuacgaccccaccgaggagaccccggcgccccugggcacgcccgacuucguggggaagauccacggcaugcucacccagaccacccaggggagcggcuccacgcgggcccaccgcgccaccgucuacgugggcagcgccgaguucacccccaagcuggggaaggugcaguuccagaccgagacggaggacgaccuggucauccggcagaacaccaaguucaccccggugggcgugauccaggaguccgaccaccaccgcgacgagccccagcaguggcggcuccccaacuacagcggggccaacaccuucaacguccaccuggcccccgccguggcgccgaacuuccccggcgagcagcuccuguucuuccgcuccacgauccccgggugcggcggccaccccaacaugaaccuggacugccugcucccgcaggagugggugcagcacuucuaccaggaggccgcccccgcccagagcgacgucgcgcugcugcgguucgugaaccccgacaccucccgcguccucuucgagugcaagcugcacaagagcggguacgugaccguggcccacaccggccagcacgaccuggugaucccgcccaacggguacuuccgguucgacuccugggucaaccaguucuacacgcucgcccccaugggcaacgggaccggccgcaagcgcuga

SEQ ID NO: 12700 - RNA, 1614 nt, Artificial Sequence
  derived and/or modified sequence opt1 from VP1__Norovirus_and/or_Norovirus-like__KX514171
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccgugaaccuggagcgccucuucaccgggcccuccagcgccaacgucgugcagccgcagaacggccggugcacgaucgacggggagcugcugggcaccacccagcucuccagcgucaacaucugcaccuuccgcggcgacgugacgcacaucgggaccacccagcacuggaccaugaaccuggccucccccaacuggaacaacuacgaccccacggaggagaccccggcgccccugggcacccccgacuucguggggaagauccacggcaugcucacccagacgacccaggggagcggcagcacccgggcccaccgcgccaccgucuacgugggcuccgccgaguucacgcccaagcuggggaaggugcgguucgagaccgacaccgaggacgaccuggucauccgccagaacaccaaguucacgccggugggcgugauccagagcuccgagcaccaccgggacgagccccagcaguggcgccuccccaacuacagcggggccaacaccuucaacguccaccuggcccccgccguggcgccgaacuuccccggcgagcagcuccuguucuuccgguccacccugcccgggugcggcggccaccccaacauggaccuggacugccuccugccgcaggagugggugcagcacuucuaccaggaggccgcccccgcccagagcgacgucgcgcugcuccgcuucgugaaccccgacaccucccgggugcuguucgagugcaagcugcacaagagcggguacgucacgguggcccacaccggccaguacgaccucgugcugcccuccaacggguacuuccgcuucgacagcugggucaaccaguucuacacccuggccccgaugggcaacgggaccggccgccggcgcuga

SEQ ID NO: 12701 - RNA, 1614 nt, Artificial Sequence
  derived and/or modified sequence opt1 from VP1__Norovirus_and/or_Norovirus-like__KX514170
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccgugaaccuggagcgccucuucaccgggcccuccagcgccaacgucgugcagccgcagaacggccggugcacgaucgacggggagcugcugggcaccacccagcucuccagcgucaacaucugcaccuuccgcggcgacgugacgcacaucgggaccacccagcacuggaucaugaaccuggccucccccaacuggaacaacuacgaccccaccgaggagacgccggcgccccugggcacccccgacuucguggggaagauccacggcaugcucacccagaccacgcaggggagcggcagcacccgggcccaccgcgccaccgucuacgugggcuccgccgaguucacccccaagcuggggaaggugcgguucgagacggacaccgaggacgaccuggucauccgccagaacaccaaguucaccccggugggcgugauccagagcuccgagcaccaccgggacgagccccagcaguggcgccuccccaacuacagcggggccaacacguucaacguccaccuggcccccgccguggcgccgaacuuccccggcgagcagcuccuguucuuccgguccacccugcccgggugcggcggccaccccaacauggaccuggacugccuccugccgcaggagugggugcagcacuucuaccaggaggccgcccccgcccagagcgacgucgcgcugcuccgcuucgugaaccccgacaccucccgggugcuguucgagugcaagcugcacaagagcggguacgucaccguggcccacacgggccaguacgaccucgugcugcccuccaacggguacuuccgcuucgacagcugggucaaccaguucuacacccuggccccgaugggcaacgggaccggccgccggcgcuga

SEQ ID NO: 12702 - RNA, 1614 nt, Artificial Sequence
  derived and/or modified sequence opt1 from VP1__Norovirus_and/or_Norovirus-like__KF806533
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgaccugacgcacuucgccggcacccacgaguacgccaugaaccuggcgagccagaacuggaccaacuacgacccgaccgaggagauccccgcgccccucggggcccccgacuucgugggcaagauccgcgggguccugacgcagaccacccggggcgacggguccacccgcggccaccgggccacgcugagcaccggcagcgcccacuucaccccgaagcucggguccgugcgcuucagcaccgacacgaacaacgacuucgaggccggccagaacaccaaguucacccccgugggggucuuccaggacggcgacaaccaccagaacgagccccagcagugggugcugcccaacuacuccggggccaccgcccacaacgugcaccuggccccggcggucgcccccgccuuccccggcgagcagcuccuguucuuccggagcacgaugcccggcugcuccggguacccgaacaugaaccuggacugccuccugccccaggagugggugcagcacuucuaccaggaggccgcccccgcgcagagcgacguggcccugcuccgcuucgucaaccccgacaccucccgggugcuguucgagugcaagcugcacaagagcggcuacgugaccgucgcccacaccgggcagcacgaccucgugaucccgcccaacggcuacuuccgcuucgacuccugggugaaccaguucuacacgcuggcccccauggggaacggcaccggccggcgccgcuga

SEQ ID NO: 12703 - RNA, 1614 nt, Artificial Sequence
  derived and/or modified sequence opt1 from VP1__Norovirus_and/or_Norovirus-like__KF806528
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccugggaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggcgccuucgucgugcagccccagaacgggcgcugcaccacggacggcguccuccuggggaccacccagcucagccccgugaacaucugcaccuuccggggcgaccugacgcacuucgccggcacccacgaguacgccaugaaccuggcgucccagaacuggaacaacuacgacccgaccgaggagauccccgcgccccucggggcccccgacuucgugggcaagauccgcgggguccugacccagacgacccggcgcgacggcagcacccgggggcaccgcgccacccuguccacgggcagcgcccacuucaccccgaagcucggcagcauccgguucuccaccgacaccaacaacgacuucgaggccgggcagaacacgaaguucacccccgugggcguguuccaggacggggacaaccaccagaacgagccccagcaguggguccugcccaacuacagcggcgccaccgcccacaacgugcaccuggccccggcgguggcccccgccuuccccggggagcagcuccuguucuuccgcuccaccaugcccggcugcagcggcuacccgaacaugaaccuggacugccuccugccccaggaguggguccagcacuucuaccaggaggccgcccccgcgcaguccgacguggcccugcuccgguucgugaaccccgacacgagccgcguccuguucgagugcaagcugcacaaguccggguacgugaccguggcccacaccggccagcacgaccucgucaucccgcccaacggguacuuccgguucgacagcugggugaaccaguucuacacccuggcccccaugggcaacgggacgggccgccgccgguga

SEQ ID NO: 12704 - RNA, 1614 nt, Artificial Sequence
  derived and/or modified sequence opt1 from VP1__Norovirus_and/or_Norovirus-like__KF806527
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgaccugacgcacuucgccggcaccagcgaguacgccaugaaccuggcgucccagaacuggaccaacuacgacccgaccgaggagauccccgcgccccucggggcccccgacuucgugggcaagauccgcgggguccugacgcagaccacccggggcgacgggagcacccgcggccaccgggccacgcugagcaccggcuccgcccacuucaccccgaagcucgggagcgugcgcuucuccaccgacacgaacaacgacuucgaggccggccagaacaccaaguucacccccgugggggucuuccaggacggcgacaaccaccagaacgagccccagcagugggugcugcccaacuacagcggggccaccgcccacaacgugcaccuggccccggcggucgcccccgccuuccccggcgagcagcuccuguucuuccgguccacgaugcccggcugcagcggguacccgaacaugaaccuggacugccuccugccccaggagugggugcagcacuucuaccaggaggccgcccccgcgcaguccgacguggcccugcuccgcuucgucaaccccgacaccagccgggugcuguucgagugcaagcugcacaaguccggcuacgugaccgucgcccacaccgggcagcacgaccucgugaucccgcccaacggcuacuuccgcuucgacagcugggugaaccaguucuacacgcuggcccccauggggaacggcaccggccggcgccgcuga

SEQ ID NO: 12705 - RNA, 1614 nt, Artificial Sequence
  derived and/or modified sequence opt1 from VP1__Norovirus_and/or_Norovirus-like__KX514261
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccgucuacgugggcuccgccgaguucacccccaagcuggggaaggugcaguuccagacggagaccgaggacgaccuggucauccggcagaacaccaaguucaccccggugggcgugauccaggagagcgaccaccaccgcgacgagccccagcaguggcggcuccccaacuacuccggggccaacacguucaacguccaccuggcccccgccguggcgccgaacuuccccggcgagcagcuccuguucuuccgcagcacccugcccgggugcggcggccaccccaacauggaccuggacugccuccugccgcaggagugggugcagcacuucuaccaggaggccgcccccgcccaguccgacgucgcgcugcuccgguucgugaaccccgacaccagccgcgugcuguucgagugcaagcugcacaaguccggguacgucaccguggcccacacgggccaguacgaccucgugcugcccagcaacggguacuuccgguucgacuccugggucaaccaguucuacacccuggccccgaugggcaacgggaccggccgccgccgguga

SEQ ID NO: 12706 - RNA, 1614 nt, Artificial Sequence
  derived and/or modified sequence opt1 from VP1__Norovirus_and/or_Norovirus-like__AB684720
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccugucccgcauguacaacggcuacgccgggggcuucgaggugcaggucauccucgccgggaacgccuucacggccggcaagaucaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccaggcccacgacagcacccugaagcucaucgccaugcuguacacgccccugcgggccaacaacgcgggcgacgacguguucaccguguccugccgcguccucacccggcccagcccggacuucgacuucaucuuccuggugccgcccaccguggagucccgcacgaagcccuucagcguccccauccugaccguggaggagauguccaacagccgguuccccaucccccucgagaagcuguacaccggccccuccagcgccuucgugguccagccgcagaacgggcgcugcaccacggacggcgugcugcucgggaccacccagcuguccgccgucaacaucugcaacuuccggggcgacgugacccacauccgcggcagccgggacuacacgaugaaccuggugagccagaacuggaacaacuacgaccccaccgaggagauccccgccccgcucgggacccccgacuucgucggcaagauccaggggcugcugacccagacgacccgcgccgacggcuccacccgggcgcacaaggccaccgugagcacgggguccgugcacuucacccccaagcucggcagcguccaguucaccaccgacacggacaacgacuuccagaccggccagaacaccaaguucacccccgugggggugauccaggacuccgaccaccaccagaacgagccgcagcaguggguccugcccaacuacagcggcgccuccgggcacaacgugcaccuggcccccgccguggcgcccacguucccgggcgagcagcuccuguucuuccgcagcaccaugcccgggugcuccggcuaccccaacaugaaccuggacugccuccugccccaggaguggguccugcacuucuaccaggaggccgccccggcccagagcgacguggcgcuccugcgguucgugaaccccgacaccggccgcguccuguucgagugcaagcuccacaaguccggguacaucaccguggcccacacgggccccuacgaccuggugaucccgcccaacggguacuuccgguucgacagcugggucaaccaguucuacacccuggcccccaugggcaacgggaccggccgccggcgcuga

SEQ ID NO: 12707 - RNA, 1614 nt, Artificial Sequence
  derived and/or modified sequence opt1 from VP1__Norovirus_and/or_Norovirus-like__LC016605
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccagaucaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggccaacaacgcgggcgacgacgucuucaccguguccugccgcgugcugacccggcccagcccggacuucgacuucaucuuccucgucccgcccaccguggagucccgcacgaagcccuucaccgugcccauccugaccgucgaggagaugaccaacagccgguuccccaucccccuggagaagcuguucacgggccccuccagcgccuucguggugcagccgcagaacgggcgcugcaccaccgacggcguccugcuggggaccacgcagcucucccccgugaacaucugcaccuuccggggcgacgucacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgugagcacgggcagcgucgacuucaccccgaagcugggguccgugcaguucgacaccgacaccaacaacgaccuggagacgggccagaacacccgguucacccccgugggggucauccaggacggcagcgcccaccgcaacgagccccagcagugggugcuccccgacuacuccgggcggaccgugcacaacguccaccuggccccggccguggcccccacguuccccggcgagcagcuccucuucuuccgcagcaccaugcccggcugcuccggguacccgaacauggaccuggacugccugcucccccaggagugggugcagcacuucuaccaggaggccgcgcccgcccagagcgacgucgcccugcugcgguucgugaaccccgacaccggccgcguccucuucgagugcaagcugcacaagaccggguacgugaccguggcccacacgggccagcacgaccuggugaucccgcccaacggguacuuccgguucgacuccugggucaaccaguucuacacccucgcgcccaugggcaacggcgccgggcgccgccgguga

SEQ ID NO: 12708 - RNA, 1614 nt, Artificial Sequence
  derived and/or modified sequence opt1 from VP1__Norovirus_and/or_Norovirus-like__KF806529
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucgccgggacccacgaguacgccaugaaccuggcgucccagaacuggagcaacuacgacccgaccgaggagauccccgcgccccucggcgcccccgacuucguggggaagauccgcggcguccugacccagacgacccgcggggacggcuccacccggggccaccgggccacccugagcacggggagcgcccacuucaccccgaagcucggcuccauccgcuucagcaccgacaccaacaacgacuucgaggccgggcagaacacgaaguucacccccgugggcguguuccaggacggggacaaccaccagaacgagccccagcaguggguccugcccaacuacuccggcgccaccgcccacaacgugcaccuggccccggcgguggcccccgccuuccccggcgagcagcuccuguucuuccggagcaccaugcccgggugcuccggcuacccggacaugaaccuggacugccuccugccccaggaguggguccagcacuucuaccaggaggccgcccccgcgcagagcgacguggcccugcuccgcuucgugaaccccgacacgucccggguccuguucgagugcaagcugcacaagagcggguacgugaccguggcccacaccggccagcacgaccucgucaucccgcccaacggguacuuccgcuucgacuccugggugaaccaguucuacacccuggcccccaugggcaacggcacggggcggcgccgcuga

SEQ ID NO: 12709 - RNA, 1614 nt, Artificial Sequence
  derived and/or modified sequence opt1 from VP1__Norovirus_and/or_Norovirus-like__JX023286
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccaggcccacgacagcacccugaagcucaucgccaugcuguacacgccccugcgggcgaacaacgccggcgacgacguguucaccguguccugccgcguccucacccggcccagcccggacuucgacuucaucuuccuggugccgcccaccguggagucccgcaccaagcccuucacgguccccauccugaccguggaggagaugagcaacucccgguuccccaucccccucgagaagcuguacaccggccccagcuccgccuucgugguccagccgcagaacgggcgcugcaccacggacggcgugcugcucgggaccacccagcugagcgccgucaacaucugcaacuuccggggcgacgugacccgcgugggcaucucccacgacuacacgaugaaccuggucagccagaacuggaacaacuacgaccccaccgaggagauccccgccccgcucgggacccccgacuucgugggcaagauccaggggcugcugacccagacgacccgggcggacggcagcacccgcgcccacaaggccaccguguccacggggagcguccacuucacccccaagcucggcuccgugcaguucaccaccgacacgaacaacgacuuccagaccggccagaacaccaaguucacccccgugggggucauccaggacggcgaccaccaccagaacgagccgcagcagugggugcugcccaacuacagcgggacguccggccacaacgugcaccuggcccccgccgucgcgcccaccuucccgggggagcagcuccuguucuuccggagcaccaugcccggcugcuccggcuaccccaacaugaaccuggacugccuccugccccaggagugggugcugcacuucuaccaggaggccgccccggcccagagcgacguggcgcuccugcgcuucgucaaccccgacaccgggcgggugcuguucgagugcaagcuccacaaguccggcuacaucacgguggcccacaccgggcccuacgaccuggucaucccgcccaacggcuacuuccgcuucgacagcugggugaaccaguucuacacccuggcccccauggggaacggcaccggccggcgccgguga

SEQ ID NO: 12710 - RNA, 1614 nt, Artificial Sequence
  derived and/or modified sequence opt1 from VP1__Norovirus_and/or_Norovirus-like__FJ537137
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccugagccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucaucguggacgugcggcagcuggagcccguccucaucccgcugcccgacgugcgcaacaacuucuaccacuacaaccaggcccacgacuccacccugaagcucaucgccaugcuguacacgccccugcgggcgaacaacgccggcgacgacguguucaccgucagcugccgcgugcucacccggcccuccccggacuucgacuucaucuuccuggugccgcccaccgucgagagccgcaccaagcccuucacggugcccauccugaccguggaggagauguccaacagccgguuccccaucccccucgagaagcuguacaccggccccuccagcgccuucgucgugcagccgcagaacgggcgcugcaccacggacggcguccugcucgggaccacccagcuguccgccgugaacaucugcaacuuccggggcgacgugacccacaucgucggcagccacgacuacacgaugaaccuggugucccagaacuggagcaacuacgaccccaccgaggagauccccgccccgcucgggacccccgacuucgugggcaagauccaggggcugcugacccagacgacccgcgcggacggcagcacccgggcccacaaggccaccgucuccacggggagcgugcacuucauccccaagcucggcuccgugcaguucaccaccgacaccaacaacgacuuccagacgggccagaacaccaaguucacccccgucggggugauccaggacggcgaccaccaccagaacgagccgcagcagugggugcugcccaacuacagcgggcgcaccggccacaacguccaccuggcccccgccguggcgcccacguucccgggggagcagcuccuguucuuccgguccaccgugcccggcugcagcggcuaccccaacaugaaccuggacugccuccugccccaggagugggucucccacuucuaccaggaggccgccccggcccagagcgacguggcgcugcuccgcuucgugaaccccgacaccgggcggguccuguucgagugcaagcugcacaaguccggcuacaucaccguggcccacacggggcccuacgaccucgugcugcccccgaacggcuacuuccgcuucgacagcugggucaaccaguucuacacccuggcccccauggggaacggcaccggccggcgccgguga

SEQ ID NO: 12711 - RNA, 1614 nt, Artificial Sequence
  derived and/or modified sequence opt1 from VP1__Norovirus_and/or_Norovirus-like__X76716
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccugagccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucaucguggacgugcggcagcuggagcccguccucaucccgcugcccgacgugcgcaacaacuucuaccacuacaaccaggccaacgacuccacccugaagcucaucgccaugcuguacacgccccugcgggcgaacaacgccggcgacgacguguucaccgucagcugccgcgugcucacccggcccuccccggacuucgacuucaucuuccuggugccgcccaccgucgagagccgcaccaagcccuucacggugcccgugcugaccgucgaggagauguccaacagccgguuccccaucccccucgagaagcuguacaccggccccuccagcgccuucgugguccagccgcagaacgggcgcugcaccacggacggcgugcugcucgggaccacccagcuguccgccgugaacaucugcaacuuccggggcgacgucacccacaucgccggcagccacgacuacacgaugaaccuggcgucccagaacuggagcaacuacgaccccaccgaggagauccccgccccgcucgggacccccgacuucgugggcaagauccaggggcugcugacccagacgacccgcgccgacggcagcacccgggcccacaaggccaccguguccacggggagcguccacuucacccccaagcucggcuccgugcaguucaccaccgacacgaacaacgacuuccaggcgggccagaacaccaaguucacccccgugggggucauccaggacggcgaccaccaccagaacgagccgcagcaguggcugcugcccaacuacagcgggcgcaccggccacaacgugcaccucgcccccgccguggcccccacguucccgggggagcagcugcuguucuuccgguccaccaugcccggcugcagcggcuaccccaacaugaaccucgacugccugcugccccaggaguggguccuccacuucuaccaggaggcggccccggcccaguccgacguggcccugcugcgcuucgugaaccccgacaccgggcggguccucuucgagugcaagcugcacaagagcggcuacaucaccguggcccacacggggcccuacgaccuggugcugcccccgaacggcuacuuccgcuucgacuccugggucaaccaguucuacacccucgcgcccauggggaacggcaccggccggcgccgguga

SEQ ID NO: 12712 - RNA, 1614 nt, Artificial Sequence
  derived and/or modified sequence opt1 from VP1__Norovirus_and/or_Norovirus-like__KX514328
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccaucaaccuggagcgccucuucaccgggcccuccagcgccaacgugguccagccgcagaacggccggugcacgaucgacggggagcugcugggcaccacccagcucuccagcgugaacaucugcaccuuccgcggcgacgucacgcagaucggguccaccaagcacuggaccaugaaccuggccagccccaacuggaacaacuacgaccccaccgaggagacgccggcgccccugggcacccccgacuucguggggaagauccacggcaugcucacccagaccacgcaggagaacgggagcacccgggcccaccgcgccaccguguacgucggcggcgccaacuucacccccaagcuggggaaggugcaguucgagacggacaccguggacgaccuggagauccggcagaacaccaaguucaccccggucggcgugauccaguccagcgaccaccaccgcgacgagccccagcaguggcggcuccccaacuacuccggggccaacacguucaacgugcaccuggcccccgccgucgcgccgaacuuccccggcgagcagcuccuguucuuccgcagcacccugcccgggugcggcggccaccccaacauggaccuggacugccuccugccgcaggagugggugcagcacuucuaccaggaggccgcccccgcccaguccgacguggcgcugcuccgguucgucaaccccgacaccagccgcgugcuguucgagugcaagcugcacaaguccggguacgugaccgucgcccacacgggccaguacgaccucgugcugcccagcaacggguacuuccgguucgacuccugggugaaccaguucuacacccuggccccgaugggcaacgggaccggccgccgccgguga

SEQ ID NO: 12713 - RNA, 1614 nt, Artificial Sequence
  derived and/or modified sequence opt1 from VP1__Norovirus_and/or_Norovirus-like__KX514201
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacgucaucguggacgugcggcagcuggagcccguccucaucccgcugcccgacgugcgcaacaacuucuaccacuacaaccaguccaacgacagcaccaucaagcugaucgccaugcucuacacgccccugcgggcgaacaaccccggcgacgacguguucaccgucuccugccgcgugcugacccggccgagccccgacuucgacuucaucuuccucgugccgcccaccgucgagucccgcacgaagcccuucagcgugcccauccugaccgugggcgagaugaccaacucccgguuccccaucaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccgucuacgugggcuccgccgaguucacccccaagcuggggaaggugcaguucaagacggagaccgaccacgaccugaccauccggcagaacaccaaguucacgccggucggcgugauccaggagagcgaccaccaccgcgacgagccccagcaguggcggcuccccaacuacuccggggccaacaccuucaacgugcaccuggcccccgccgucgcgccgaacuuccccggcgagcagcuccuguucuuccgcagcacccugcccgggugcggcggccaccccaacauggaccuggacugccuccugccgcaggagugggugcagcacuucuaccaggaggccgcccccgcccaguccgacguggcgcugcuccgguucgucaaccccgacaccagccgcgugcuguucgagugcaagcugcacaaguccggguacgugacggucgcccacaccggccaguacgaccucgugcugcccagcaacggguacuuccgguucgacuccugggugaaccaguucuacacccuggccccgaugggcaacgggaccggccgccgccgguga

SEQ ID NO: 12714 - RNA, 1614 nt, Artificial Sequence
  derived and/or modified sequence opt1 from VP1__Norovirus_and/or_Norovirus-like__AB985442
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagccacgacuccacccugaagcucaucgccaugcuguacacgccccugcgggccaacaacgcgggcgacgacguguucaccgugagcugccgcguccucacccggcccuccccggacuucgacuucaucuuccuggugccgcccaccguggagagccgcaccaagcccuucacgguccccauccugaccguggaggagauguccaacagccgguuccccaucccccucgagaagcuguacaccggccccuccagcgccuucgugguccagccgcagaacgggcgcugcaccacggacggcgugcugcucgggaccacccagcuguccgccgucaacaucugcaacuuccggggcgacgugacccacaucgugggcagccacgacuacacgaugaaccuggccagccagaacugguccaacuacgaccccaccgaggagauccccgccccgcucgggacccccgacuucgucggcaagauccaggggcugcgcacccagacgacccgggcggacggcagcacccgcgcccacaaggccaccguguccacggggagcgugcacuucacccccaagcugggcuccguccaguucaccaccgacacgaacaacgacuuccagaccggccagaacaccaaguucacccccgugggggugauccaggacggcgaccaccaccagaacgagccgcagcaguggguccuccccaacuacagcgggcggacgggccacaacgugcaccuggcccccgccguggcgcccaccuucccgggggagcagcuccuguucuuccgcuccaccaugcccggcugcagcggcuaccccaacaugaaccuggacugccugcucccccaggaguggguccugcacuucuaccaggaggccgccccggcccaguccgacguggcgcugcuccgguucgugaaccccgacaccgggcgcguccuguucgagugcaagcugcacaagagcggcuacaucacgguggcccacaccgggcccuacgaccucgugaucccgcccaacggcuacuuccgguucgacuccugggucaaccaguucuacacccuggcccccauggggaacggcaccggccgccggcgcuga

SEQ ID NO: 12715 - RNA, 1614 nt, Artificial Sequence
  derived and/or modified sequence opt1 from VP1__Norovirus_and/or_Norovirus-like__LC016604
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcacgaagcccuucaccguccccauccugaccguggaggagaugaccaacagccgguuccccaucccccuggagaagcuguucacgggccccuccagcgccuucgugguccagccgcagaacgggcgcugcaccaccgacggcgugcugcuggggaccacgcagcucucccccgucaacaucugcaccuuccggggcgacgugacccacauccccggcacccgcacguaccggaugaaccuggccagccagaacuggaacaacuacgacccgaccgaggagauccccgcgccccuggggacccccgacuucgugggcaagauccaggggaugcucacccagacgaccaagggcgacggguccacccgcggccacaaggccaccgucagcacgggcagcguggacuucaccccgaagcugggguccgugcaguucgacaccgacaccaacaacgaccuggagacgggccagaacacccgguucacccccgucggggugauccaggacggcagcgcccaccgcaacgagccccagcagugggugcuccccgacuacuccgggcggaccguccacaacgugcaccuggccccggccguggcccccacguuccccggcgagcagcuccucuucuuccgcagcaccaugcccggcugcuccggguacccgaacauggaccuggacugccugcucccccaggaguggguccagcacuucuaccaggaggccgcgcccgcccagagcgacguggcccugcugcgguucgugaaccccgacaccggccgcguccucuucgagugcaagcugcacaagaccggguacgugaccguggcccacacgggccagcacgaccuggucaucccgcccaacggguacuuccgguucgacuccugggugaaccaguucuacacccucgcgcccaugggcaacggcgccgggcgccgccgguga

SEQ ID NO: 12716 - RNA, 1614 nt, Artificial Sequence
  derived and/or modified sequence opt1 from VP1__Norovirus_and/or_Norovirus-like__KF806532
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgaccugacgcacuucgccggcaccagcgaguacgccaugaaccuggcgucccagaacuggaccaacuacgacccgaccgaggagauccccgcgccccucggggcccccgacuucgugggcaagauccgcgggguccugacgcagaccacccggcgcgacggcagcacccgggggcaccgcgccacgcugagcaccggcuccgcccacuucaccccgaagcucggcagcauccgguucuccaccgacacgaacaacgacuucgaggccgggcagaacaccaaguucacccccgugggcguguuccaggacggggacaaccaccagaacgagccccagcaguggguccugcccaacuacagcggcgccaccgcccacaacgugcaccuggccccggcgguggcccccgccuuccccggggagcagcuccuguucuuccgcuccacgaugcccggcugcagcggcuacccgaacaugaaccuggacugccuccugacccaggaguggguccagcacuucuaccaggaggccgcccccgcgcaguccgacguggcccugcuccgguucgugaaccccgacaccagccgcguccuguucgagugcaagcugcacaaguccggguacgugaccguggcccacacgggccagcacgaccucgucaucccgcccaacggguacuuccgguucgacagcugggugaaccaguucuacacccuggcccccaugggcaacgggaccggccgccgccgguga

SEQ ID NO: 12717 - RNA, 1614 nt, Artificial Sequence
  derived and/or modified sequence opt1 from VP1__Norovirus_and/or_Norovirus-like__FJ537138
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccugucccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccaggcccacgacagcacccugaagcucaucgccaugcuguacacgccccugcgggcgaacaacgccggcgacgacguguucaccgucuccugccgcgugcucacccggcccagcccggacuucgacuucaucuuccuggugccgcccaccgucgagucccgcaccaagcccuucacggugcccauccugaccguggaggagaugagcaacucccgguuccccaucccccucgagaagcuguacaccggccccagcuccgccuucgucgugcagccgcagaacgggcgcugcaccacggacggcguccugcucgggaccacccagcugagcgccgugaacaucugcaacuuccggggcgacgugacccgcgucggcaucucccacgacuacacgaugaaccuggugagccagaacuggaacaacuacgaccccaccgaggagauccccgccccgcucgggacccccgacuucgugggcaagauccaggggcugcugacccagacgacccgggcggacggcagcacccgcgcccacaaggccaccgucuccacggggagcgugcacuucacccccaagcucggcuccgugcaguucaccaccgacacgaacaacgacuuccagaccggccagaacaccaaguucacccccgucggggugauccaggacggcgaccaccaccagaacgagccgcagcagugggugcugcccaacuacagcgggacguccggccacaacguccaccuggcccccgccguggcgcccaccuucccgggggagcagcuccuguucuuccggagcaccaugcccggcugcuccggcuaccccaacaugaaccuggacugccuccugccccaggagugggugcugcacuucuaccaggaggccgccccggcccagagcgacgucgcgcuccugcgcuucgugaaccccgacaccgggcgggugcuguucgagugcaagcuccacaaguccggcuacaucacggucgcccacaccgggcccuacgaccuggugaucccgcccaacggcuacuuccgcuucgacagcugggugaaccaguucuacacccuggcccccauggggaacggcaccggccggcgccgguga

SEQ ID NO: 12718 - RNA, 1614 nt, Artificial Sequence
  derived and/or modified sequence opt1 from VP1__Norovirus_and/or_Norovirus-like__AY030098
augaagauggccagcuccgacgccaaccccagcgacggcuccaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugagccaccugucccgcauguacaacggcuacgccgggggcuucgagguccaggugauccucgccgggaacgccuucacggccggcaaggugaucuucgcggccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagccacgacuccacccugaagcucaucgccaugcuguacacgccccugcgggccaacaacgccggcgacgacguguucaccgugagcugccgcguccucacccggcccuccccggacuucgacuucaucuuccuggugccgcccaccguggagagccgcacgaagcccuucaccguccccauccugaccguggaggagauguccaacagccgguuccccaucccccucgagaagcuguacaccggccccuccagcgcguucgugguccagccgcagaacgggcgcugcacgaccgacggcgugcugcucgggaccacccagcuguccgccgucaacaucugcaacuuccggggcgacgugacgcacaucgugggcagccacgacuacaccaugaaccuggucagccagaacugguccaacuacgaccccaccgaggagauccccgccccgcucgggacccccgacuucgugggcaagauccaggggcugcugacgcagaccacccgcgccgacggcagcacccgggcccacaaggcgacgguguccaccgggagcguccacuucacccccaagcucggcuccgugcaguucaccacggacaccaacaacgacuuccagaccggccagaacaccaaguucacgcccgugggggucauccaggacggcgaccaccaccagaacgagccgcagcagugggugcugcccgacuacagcgggcgcaccggccacaacgugcaccuggcccccgccgucgcccccaccuucccgggggagcagcuccuguucuuccgguccaccaugcccggcugcagcggcuaccccaacaugaaccuggacugccuccugccccaggagugggugcugcacuucuaccaggaggccgcgccggcccaguccgacguggcccuccugcgcuucgucaaccccgacacggggcgggugcuguucgagugcaagcuccacaagagcggcuacaucaccguggcccacaccgggcccuacgaccuggucaucccgcccaacggcuacuuccgcuucgacuccugggugaaccaguucuacacccuggcgcccauggggaacggcaccggccggcgccgguga

SEQ ID NO: 12719 - RNA, 1614 nt, Artificial Sequence
  derived and/or modified sequence opt1 from VP1__Norovirus_and/or_Norovirus-like__AY532130
augaagauggccagcaacgacgccaaccccuccgacggcagcaccgcgaaccuggugccggaggucaacaacgaggugauggcccucgagcccguggucggggccgccaucgccgcgcccguggccggccagcagaacaucaucgaccccuggauccgcaacaacuucgugcaggcccccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccagcacggcgggcaagaucaucuucgccgccgugccgcccaacuucccgaccgaggggcugucccccagccaggugaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggccaacaacgcgggcgacgacgucuucaccguguccugccgcgugcugacccggcccagcccggacuucgacuucaucuuccucgucccgcccaccguggagucccgcaucaagcccuucacggugcccauccugaccgucgaggagaugagcaacucccgguuccccaucccccuggagaagcucuacaccggccccagcuccgccuucguggugcagccgcagaacgggcgcugcaccacggacggcguccugcuggggaccacccagcucagcgccgugaacaucugcaccuuccggggcgacgucacgcacaucgccggcucccacgacuacaccaugaaccuggccagccagaacuggaacaacuacgaccccaccgaggagauccccgcgccgcuggggacccccgacuucgugggcaagauccaggggaugcucacgcagaccacccgcgaggacggcagcacccgggcccacaaggccacgguguccaccgggagcgcccacuucacccccaagcugggcuccguccaguacaccacggacaccaacaacgacuuccagaccggccagaacaccaaguucacgcccgugggggugauccaggacggcaacaaccaccagaacgagccgcagcaguggguccugcccagcuacuccgggcgcaccggccacaacgugcaccucgcccccgcgguggcccccaccuucccgggggagcagcugcuguucuuccggagcaccaugcccggcugcuccggcuaccccaacaugaaccucgacugccugcugccccaggaguggguccagcacuucuaccaggaggccgccccggcgcagagcgacguggcccuccugcgcuucgugaaccccgacacggggcggguccuguucgagugcaagcuccacaaguccggcuacgugaccguggcccacaccgggccccacgaccuggucaucccgcccaacggcuacuuccgcuucgacagcugggugaaccaguucuacacccuggcccccaugcggaacggggccggccgccggcgcuga

SEQ ID NO: 12720 - RNA, 1614 nt, Artificial Sequence
  derived and/or modified sequence opt1 from VP1__Norovirus_and/or_Norovirus-like__KX514286
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccaucaaccuggagcgccucuucacggggcccagcuccgcgaacgugguccagccgcagaacggccggugcaccaucgacggggagcugcugggcaccacccagcucagcuccgugaacaucugcacguuccgcggcgacgucacccacaucgggagcacccaccacuggaccaugaaccuggccagccccaacuggaacaacuacgaccccacggaggagaccccggcgccccugggcacccccgacuucguggggaagauccacggcaugcucacccagacgacccaggagaacggguccacccgggcccaccgcgccaccguguacgucggcagcgccgacuucacgcccaagcugggcaaggugcaguucgagaccgacaccgaggacgaccuggccauccggcagaacaccaaguucacgccggugggggucauccaguccagcgaccaccaccgcgacgagccccagcaguggcggcuccccaacuacuccggcgccaacaccuucaacgugcaccuggcccccgccguggcgccgaacuuccccggggagcagcuccuguucuuccgcagcacccugcccggcugcgggggccaccccaacauggaccuggacugccuccugccgcaggaguggguccagcacuucuaccaggaggccgcccccgcccaguccgacguggcgcugcuccgguucgugaaccccgacaccagccgcguccuguucgagugcaagcugcacaaguccggcuacgugacgguggcccacaccgggcaguacgaccucguccugcccagcaacggcuacuuccgguucgacuccugggugaaccaguucuacacccuggccccgauggggaacggcaccgggcgccgccgguga

SEQ ID NO: 12721 - RNA, 1614 nt, Artificial Sequence
  derived and/or modified sequence opt1 from VP1__Norovirus_and/or_Norovirus-like__KX514202
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccguguacgucggcuccgccgaguucacccccaagcuggggaaggugcaguucaagacggagaccgaccacgaccugaccauccggcagaacaccaaguucacgccggugggcgucauccaggagagcgaccaccaccgcgacgagccccagcaguggcggcuccccaacuacuccggggccaacaccuucaacgugcaccuggcccccgccguggcgccgaacuuccccggcgagcagcuccuguucuuccgcagcacccugcccgggugcggcggccaccccaacauggaccuggacugccuccugccgcaggaguggguccagcacuucuaccaggaggccgcccccgcccaguccgacguggcgcugcuccgguucgugaaccccgacaccagccgcguccuguucgagugcaagcugcacaaguccggguacgugacgguggcccacaccggccaguacgaccucguccugcccagcaacggguacuuccgguucgacuccugggugaaccaguucuacacccuggccccgaugggcaacgggaccggccgccgccgguga

SEQ ID NO: 12722 - RNA, 1614 nt, Artificial Sequence
  derived and/or modified sequence opt1 from VP1__Norovirus_and/or_Norovirus-like__DQ358208
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccugagccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucaucguggacgugcggcagcuggagcccguccucaucccgcugcccgacgugcgcaacaacuucuaccacuacaaccaggccaacgacuccacccugaagcucaucgccaugcuguacacgccccugcgggcgaacaacgccggcgacgacguguucaccgucagcugccgcgugcucacccggcccuccccggacuucgacuucaucuuccuggugccgcccaccgucgagagccgcaccaagcccuucacggugcccgugcugaccgucgaggagauguccaacagccgguuccccaucccccucgagaagcuguacaccggccccuccagcgccuucgugguccagccgcagaacgggcgcugcaccacggacggcgugcugcucgggaccacccagcuguccgccgugaacaucugcaacuuccggggcgacgucacccacaucgccggcagccacgacuacacgaugaaccuggcgucccagaacuggagcaacuacgaccccaccgaggagauccccgccccgcucgggacccccgacuucgugggcaagauccaggggcugcugacccagacgacccgcgccgacggcagcacccgggcccacaaggccaccguguccacggggagcguccacuucacccccaagcucggcuccgugcaguucaccaccgacacgaacaacgacuuccaggcgggccagaacaccaaguucacccccgugggggucauccaggacggcgaccaccaccagaacgagccgcagcaguggagccugcccaacuacuccgggcgcaccggccacaacgugcaccuggcccccgccguggcccccacguucccgggggagcagcuccuguucuuccggagcaccaugcccggcugcuccggcuaccccaacaugaaccuggacugccuccugccccaggaguggguccugcacuucuaccaggaggcggccccggcccagagcgacguggcccuccugcgcuucgugaaccccgacaccgggcggguccuguucgagugcaagcuccacaaguccggcuacaucaccguggcccacacggggcccuacgaccuggugcugcccccgaacggcuacuuccgcuucgacagcugggucaaccaguucuacacccucgcgcccauggggaacggcaccggccggcgccgguga

SEQ ID NO: 12723 - RNA, 1614 nt, Artificial Sequence
  derived and/or modified sequence opt1 from VP1__Norovirus_and/or_Norovirus-like__AF414425
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgccagcccccggaacgcgcccggggagauccugugguccgcgccccugggcccggaccucaaccccuaccugucccaccuggcccgcauguacaacggcuacgccgggggcuucgagguccaggugauccucgccgggaacgccuucacggccggcaagaucaucuucgccgccgugccgcccaacuucccgaccgaggggcugagccccucccaggugaccauguucccccacaucaucguggacguccggcagcuggagcccgugcucaucccgcugcccgacgugcgcaacaacuucuaccacuacaaccagagcaacgacuccaccaucaagcugaucgccaugcucuacacgccccugcgggcgaacaacgccggcgacgacgucuucaccgccagcugccgcgugcugacccggcccuccccggacuucgacuucaucuuccucgugccgcccaccgucgagagccgcacgaagcccuucaccgugcccauccugaccguggaggagauguccaacagccgguuccccaucccccuggagaagcucuacaccggccccuccagcgccuucgucgugcagccgcaguccgggcgcugcacgaccgacggcgugcugcuggggaccacccagcucagcgccgucaacaucugcacguuccggggcgacgugacccacaucgcgggcucccacgacuacaccaugaaccuggccagccagaacuggaacaacuacgaccccaccgaggagauccccgccccgcuggggacgcccgacuucgucggcaagauccaggggaugcucacccagaccacccgcgaggacggcagcacgcgggcccacaaggccaccguguccaccgggagcgugcacuucacccccaagcugggcuccguccaguacacgaccgacaccaacaacgacuuccagaccggccagaacacgaaguucacccccgugggggugauccaggacggcaacaaccaccagaacgagccgcagcaguggguccugcccaacuacagcgggcgcaccggccacaacgugcaccucgcgcccgccguggcccccaccuucccgggggagcagcugcuguucuucaaguccacgaugcccggcugcagcggcuaccccaacaugaaccucgacugccugcugccccaggaguggguccagcacuucuaccaggaggccgcgccggcccaguccgacguggcccuccugcgguucgugaaccccgacaccgggcgcguccuguucgagugcaagcuccacaagagcggcuacgugaccguggcccacaccgggccccacgaccuggucaucccgcccaacggcuacuuccgguucgacuccugggugaaccaguucuacacccuggcccccauggggaacggcgcgggccgccggcgcuga

SEQ ID NO: 12724 - RNA, 1614 nt, Artificial Sequence
  derived and/or modified sequence opt1 from VP1__Norovirus_and/or_Norovirus-like__KX514348
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccgugaaccuggagcgccucuucaccgggcccuccagcgccaacgucgugcagccgcagaacggccggugcacgaucgacggggagcugcugggcaccacccagcucuccagcgucaacaucugcaccuuccgcggcgacgugacgcagaucggguccaccaagcacuggaccaugaaccuggccagccccaacuggaacaacuacgaccccaccgaggagacgccggcgccccugggcacccccgacuucguggggaagauccacggcaugcucacccagaccacgcaggagaacgggagcacccgggcccaccgcgccaccgucuacgugggcggcgccaacuucacccccaagcuggggaaggugcaguucgagacggacaccgucgacgaccuggagauccggcagaacaccaaguucaccccggugggcgugauccaguccagcgaccaccaccgcgacgagccccagcaguggguccuccccuccuacagcgggcgggacacgcccaacgugcaccuggccccggccguggcccccaacuuccccggcgagcagcuccuguucuuccgcuccacccugcccgggugcggcggccaccacaacauggaccuggacugccuccugccgcaggaguggguccagcacuucuaccaggaggcggcccccgcccagagcgacguggcccugcuccgguucgugaaccccgacaccucccgcguccuguucgagugcaagcugcacaagagcggguacgugaccguggcgcacacgggccaguacgaccucguccugcccuccaacggguacuuccgguucgacagcugggugaaccaguucuacacccuggccccgaugggcaacgggaccggccgccgccgguga

SEQ ID NO: 12725 - RNA, 1614 nt, Artificial Sequence
  derived and/or modified sequence opt1 from VP1__Norovirus_and/or_Norovirus-like__KX514287
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcagaucgggagcacccaccacuggaccaugaaccuggccagccccaacuggaacaacuacgaccccaccgaggagacgccggcgccccugggcacccccgacuucguggggaagauccacggcaugcucacccagaccacgcaggagaacggguccacccgggcccaccgcgccaccguguacgucggcagcgccgacuucacccccaagcugggcaaggugcaguucgagacggacaccggggacgaccuggccauccggcagaacaccaaguucaccccggugggcgucauccaguccagcgaccaccaccgcgacgagccccagcaguggcggcuccccaacuacuccggggccaacacguucaacgugcaccuggcccccgcgguggccccgaacuuccccggcgagcagcuccuguucuuccgcagcacccugcccgggugcggcggccaccccaacauggaccuggacugccuccugccgcaggaguggguccagcacuucuaccaggaggccgcccccgcgcaguccgacguggcccugcuccgguucgugaaccccgacaccagccgcguccuguucgagugcaagcugcacaaguccggguacgugaccguggcccacacgggccaguacgaccucguccugcccagcaacggguacuuccgguucgacuccugggugaaccaguucuacacccuggccccgaugggcaacgggaccggccgccgccgguga

SEQ ID NO: 12726 - RNA, 1614 nt, Artificial Sequence
  derived and/or modified sequence opt1 from VP1__Norovirus_and/or_Norovirus-like__KX514183
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcacaucgggaccacccagcacuggaccaugaaccuggccagccccaacuggaacaacuacgaccccacggaggagaccccggcgccccugggcacccccgacuucguggggaagauccacggcaugcucacccagacgacccaggggagcggcuccacccgggcccaccgcgccaccgucuacgugggcagcgccgaguucacgcccaagcuggggaaggugcgguucgagaccgacaccgaggacgaccuggucauccgccagaacaccaaguucacgccggugggcgugauccaguccagcgagcaccaccgggacgagccccagcaguggcgccuccccaacuacuccggggccaacaccuucaacguccaccuggcccccgccguggcgccgaacuuccccggcgagcagcuccuguucuuccggagcacccugcccgggugcggcggccaccccaacauggaccuggacugccuccugccgcaggagugggugcagcacuucuaccaggaggccgcccccgcccaguccgacgucgcgcugcuccgcuucgugaaccccgacaccagccgggugcuguucgagugcaagcugcacaaguccggguacgucacgguggcccacaccggccaguacgaccucgugcugcccagcaacggguacuuccgcuucgacuccugggucaaccaguucuacacccuggccccgaugggcaacgggaccggccgccggcgcuga

SEQ ID NO: 12727 - RNA, 1614 nt, Artificial Sequence
  derived and/or modified sequence opt1 from VP1__Norovirus_and/or_Norovirus-like__KX514174
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccgugaaccuggagcgccucuucaccgggcccuccagcgccaacgucgugcagccgcagaacggccggugcacgaucgacggggagcugcugggcaccacccagcucuccagcgucaacaucugcaccuuccgcggcgacgugacgcacaucgggaccacccagcacuggaccaugaaccuggccucccccaacuggaacaacuacgaccccacggaggagaccccggcgccccugggcacccccgacuucguggggaagauccacggcaugcucacccagacgacccaggggagcggcagcacccgggcccaccgcgccaccgucuacgugggcuccgccgaguucacgcccaagcuggggaaggugcgguucgagaccgacaccgaggacgaccuggucauccgccagaacaccaaguucacgccggugggcgugauccagagcuccgagcaccaccgggacgagccccagcaguggcgccuccccaacuacagcggggccaacaccuucaacguccaccuggcccccgccguggcgccgaacuuccccggcgagcagcuccuguucuuccgguccacccugcccgggugcggcggccaccccaacauggaccuggacugccuccugccgcaggagugggugcagcacuucuaccaggaggccgcccccgcccagagcgacgucgcgcugcuccgcuucgugaaccccgacaccucccgggugcuguucgagugcaagcugcacaagagcggguacgucacgguggcccacaccggccagcacgaccucgugaucccgcccaacggguacuuccgcuucgacuccugggucaaccaguucuacacccuggcccccaugggcaacgggaccggccgcaagcgguga

SEQ ID NO: 12728 - RNA, 1614 nt, Artificial Sequence
  derived and/or modified sequence opt1 from VP1__Norovirus_and/or_Norovirus-like__KF429791
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccggccaggugaccauguucccccacaucaucgucgacgugcggcagcuggagcccgugcucaucccgcugcccgacguccgcaacaacuucuaccacuacaaccagagcaacgaccccaccaucaagcugguggccaugcucuacacgccccugcgggccaacaacgcgggcgacgacguguucaccgucuccugccgcgugcugacccggccgagccccgacuucgacuucaucuuccucgugccgcccaccaucgaguccaagaccaagagcuucuccguccccauccugacgaucgaggagaugaccaacagccgcuuccccaucccccuggagaagcuguucaccgggcccuccagcacgcucguggugcagccgcagaacggccggugcaccaccgacgggguccugcucggcaccacgcagcugucccccgugaacaucugcaccuuccgcggcgacgucacccagaucaccaacacgcacagcuacgagaugaaccuggccgcccagaacuggaacuccuacgaccccaccgaggagaucccggcgccccucgggacccccgacuucgugggcaagauccagggggugcugacccagacgaccaaggagaacggcagcacccgggcccacaaggccaccgucuacacggggagcaccggcuucacccccaagcugggccgcgugcaguucgugaccgacacggaccgggaccucgagaccaaccaggacaccaaguucaccccggucggggugauccaggacggcgacgcccaccagaacgagccccagcagugggugcugcccuccuaccuggggacgaacaaccacaacguccaccucgcccccgccguggccccgaccuuccccggcgagcagcugcuguucuuccgcagcaccaugcccgggugcuccggcuaccccaacaugaaccucgacugccugcugccgcaggagugggugcaguacuucuaccaggaggcggcccccgcccagagcgacgucgcccuccugcgguucgugaaccccgacaccggccgcgugcuguucgagugcaagcuccacaaguccggguacgucaccguggcgcacacgggccggcacgaccuggugaucccgcccaacggguacuuccgcuucgacagcugggucucccccuucuacacccuggcccccaugggcaacgggaccggccggcgccgguga

SEQ ID NO: 12729 - RNA, 1614 nt, Artificial Sequence
  derived and/or modified sequence opt1 from VP1__Norovirus_and/or_Norovirus-like__AF427115
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccauccccauccugaccggcgaggagauguccaacagccgguuccccaucccccuggagaagcucuacaccgggcccuccagcgccuucgucgugcagccgcagaacggccgcugcacgaccgacggggugcugcugggcaccacccagcucuccgccgucaacaucugcacguucaagggcaacgugauccacaucgccgggagccacgacuacaccaugaaccuggccucccagaacuggaacaacuacgaccccaccgaggagacccccgcgccgcugggcacgcccgacuucgucgggaagauccagggccuccugacccagaccacccgggaggacgggagcacgcgcgcccacaaggccaccgugagcgccggcuccgugcacuucacccccaagcugggcagcguccaguacaccacggacaccaacaacgacuuccagaccgggcagaacaccaaguucacgcccgugggcgugauccaggacgggaacaaccaccagaacgagccgcagcaguggguccuccccaacuacuccggccgggccgggcacaacgugcaccuggcgcccgccguggcccccaccuucccgggcgagcagcuccuguucuuccgcagcaccaugcccggcugcuccggguaccccaacaugaaccuggacugccugcucccccaggaguggguccagcacuucuaccaggaggccgcgccggcccagagcgacguggcccugcugcgguucgugaaccccgacaccggccgcguccucuucgagugcaagcugcacaaguccggguacgugacgguggcccacaccggcccccacgaccuggucaucccgcccaacggguacuuccgguucgacagcugggugaaccaguucuacacccucgcccccaugggcaacggcgcggggcgccggcgcuga

SEQ ID NO: 12730 - RNA, 1614 nt, Artificial Sequence
  derived and/or modified sequence opt1 from VP1__Norovirus_and/or_Norovirus-like__KX514314
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccaucaaccuggagcgccucuucaccgggcccuccagcgcgaacgugguccagccgcagaacggccggugcacgaucgacggggagcugcugggcaccacccagcucuccagcgugaacaucugcaccuuccgcggcgacgucacgcagaucggguccaccaagcacuggaccaugaaccuggccagccccaacuggaacaacuacgaccccaccgaggagacgccggcgccccugggcacccccgacuucguggggaagauccacggcaugcucacccagaccacgcaggagaacgggagcacccgggcccaccgcgccaccguguacgucggcggcgccaacuucacccccaagcuggggaaggugcaguucgagacggacaccggcgacgaccuggccauccggcagaacaccaaguucaccccggugggggucauccaguccagcgaccaccaccgcgacgagccccagcaguggcggcuccccaacuacuccggcgccaacacguucaacgugcaccuggcccccgccguggcgccgaacuuccccggggagcagcuccuguucuuccgcagcacccugcccggcugcggcgggcaccccaacauggaccuggacugccuccugccgcaggaguggguccagcacuucuaccaggaggccgcccccgcccaguccgacguggcgcugcuccgguucgugaaccccgacaccagccgcguccuguucgagugcaagcugcacaaguccggcuacgugaccguggcccacacggggcaguacgaccucguccugcccagcaacggcuacuuccgguucgacuccugggugaaccaguucuacacccuggccccgauggggaacggcaccggccgccgccgguga

SEQ ID NO: 12731 - RNA, 1614 nt, Artificial Sequence
  derived and/or modified sequence opt1 from VP1__Norovirus_and/or_Norovirus-like__KX514208
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccguguacgucggcuccgccgaguucacccccaagcuggggaaggugcaguucaagacggagaccgaccacgaccugagcauccggcagaacaccaaguucaccccggugggcgucauccaggaguccgaccaccaccgcgacgagccccagcaguggcggcuccccaacuacagcggggccaacacguucaacgugcaccuggcccccgccguggcgccgaacuuccccggcgagcagcuccuguucuuccgcuccacccugcccgggugcggcggccaccccaacaugaaccuggacugccuccugccgcaggaguggguccagcacuucuaccaggaggccgcccccgcccagagcgacguggcgcugcuccgguucgugaaccccgacaccucccgcguccuguucgagugcaagcugcacaagagcggguacgugaccguggcccacacgggccaguacgaccucguccugcccuccaacggguacuuccgguucgacagcugggugaaccaguucuacacccuggccccgaugggcaacgggaccggccgccgccgguga

SEQ ID NO: 12732 - RNA, 1614 nt, Artificial Sequence
  derived and/or modified sequence opt1 from VP1__Norovirus_and/or_Norovirus-like__KX514206
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccguguacgucggcuccgccgaguucacccccaagcuggggaaggugcaguucaagacggagaccgaccacgaccugagcauccggcagaacaccaaguucaccccggugggcgucauccaggaguccgaccaccaccgcgacgagccccagcaguggcggcuccccaacuacagcggggccaacacguucaacgugcaccuggcccccgccguggcgccgaacuuccccggcgagcagcuccuguucuuccgcuccacccugcccgggugcggcggccaccccaacauggaccuggacugccuccugccgcaggaguggguccagcacuucuaccaggaggccgcccccgcccagagcgacguggcgcugcuccgguucgugaaccccgacaccucccgcguccuguucgagugcaagcugcacaagagcggguacgugaccguggcccacacgggccaguacgaccucguccugcccuccaacggguacuuccgguucgacagcugggugaaccaguucuacacccuggccccgaugggcaacgggaccggccgccgccgguga

SEQ ID NO: 12733 - RNA, 1614 nt, Artificial Sequence
  derived and/or modified sequence opt1 from VP1__Norovirus_and/or_Norovirus-like__KX514198
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccguguacgucggcuccgccgaguucacccccaagcuggggaaggugcaguucaagacggagaccgaccacgaccugaccacccggcagaacacgaaguucaccccggugggcgucauccaggagagcgaccaccaccgcgacgagccccagcaguggcggcuccccaacuacuccggggccaacaccuucaacgugcaccuggcccccgccguggcgccgaacuuccccggcgagcagcuccuguucuuccgcagcacccugcccgggugcggcggccaccccaacauggaccuggacugccuccugccgcaggaguggguccagcacuucuaccaggaggccgcccccgcccaguccgacguggcgcugcuccgguucgugaaccccgacacgagccgcguccuguucgagugcaagcugcacaaguccggguacgugaccguggcccacaccggccaguacgaccucguccugcccagcaacggguacuuccgguucgacuccugggugaaccaguucuacacccuggccccgaugggcaacgggaccggccgccgccgguga

SEQ ID NO: 12734 - RNA, 1614 nt, Artificial Sequence
  derived and/or modified sequence opt1 from VP1__Norovirus_and/or_Norovirus-like__KX514191
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcacaucgggaccacccggcacuggaccaugaaccuggccagccccaacuggaacaacuacgaccccacggaggagaccccggcgccccugggcacccccgacuucguggggaagauccacggcaugcucacccagacgacccaggggagcggcuccacccgcgcccaccgggccaccgucuacgugggcagcgccgaguucacgcccaagcuggggaaggugcgcuucgagaccgacaccgaggacgaccuggucauccggcagaacaccaaguucacgccggugggcgugauccaguccagcgagcaccaccgcgacgagccccagcaguggcggcuccccaacuacuccggggccaacaccuucaacguccaccuggcccccgccguggcgccgaacuuccccggcgagcagcuccuguucuuccgcagcacccugcccgggugcggcggccaccccaacauggaccuggacugccuccugccgcaggagugggugcagcacuucuaccaggaggccgcccccgcccaguccgacgucgcgcugcuccgguucgugaaccccgacaccagccgcgugcuguucgagugcaagcugcacaaguccggguacgucacgguggcccacaccggccaguacgaccucgugcugcccagcaacggguacuuccgcuucgacuccugggucaaccaguucuacacccuggccccgaugggcaacgggaccggccggcgccgguga

SEQ ID NO: 12735 - RNA, 1614 nt, Artificial Sequence
  derived and/or modified sequence opt1 from VP1__Norovirus_and/or_Norovirus-like__KX514187
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcacaucgggaccacccggcacuggaccaugaaccuggugagccccaacuggaacaacuacgaccccacggaggagaccccggcgccccugggcacccccgacuucgucgggaagauccacggcaugcucacccagacgacccaggggagcggcuccacccgcgcccaccgggccaccguguacgugggcagcgccgaguucacgcccaagcuggggaagguccgcuucgagaccgacaccgaggacgaccuggugauccggcagaacaccaaguucacgccggugggcgucauccaguccagcgagcaccaccgcgacgagccccagcaguggcggcuccccaacuacuccggggccaacaccuucaacgugcaccuggcccccgccguggccccgaacuuccccggcgagcagcuccuguucuuccgcagcacccugcccgggugcggcggccaccccaacauggaccuggacugccuccugccgcaggaguggguccagcacuucuaccaggaggcggcccccgcccaguccgacguggcccugcuccgguucgugaaccccgacaccagccgcguccuguucgagugcaagcugcacaaguccggguacgugacgguggcgcacaccggccaguacgaccucguccugcccagcaacggguacuuccgcuucgacuccugggugaaccaguucuacacccuggccccgaugggcaacgggaccggccggcgccgguga

SEQ ID NO: 12736 - RNA, 1614 nt, Artificial Sequence
  derived and/or modified sequence opt1 from VP1__Norovirus_and/or_Norovirus-like__KX514180
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucauccaggcccccgggggcgaguucaccgucagcccccggaacgcgcccggggagauccugugguccgcgccccugggcccggaccucaaccccuaccugagccaccuggcccgcauguacaacggcuacgccgggggcuucgagguccaggugauccucgccgggaacgccuucaccgccggcaagaucaucuucgccgccgugccgcccacguucccgaccgaggggcugucccccagccaggugaccauguucccccacaucaucguggacguccggcagcuggagcccgugcucaucccgcugcccgacgugcgcaacaacuucuaccacuacaaccaguccaacgacagcaccaucaagcugaucgccaugcucuacacgccccugcgggcgaacaaccccggcgacgacgucuucaccguguccugccgcgugcugacccggccgagccccgacuucgacuucaucuuccucgucccgcccaccguggagucccgcacgaagcccuucagcgugcccauccugaccgucggcgagaugaccaacucccgguuccccaucaaccuggagcgccucuucaccgggcccagcuccgccaacguggugcagccgcagaacggccggugcacgaucgacggggagcugcugggcaccacccagcucagcuccgucaacaucugcaccuuccgcggcgacgugacgcagaucgggagcacccagcacuggaccaugaaccuggccagccccaacuggaacaacuacgaccccaccgaggagacgccggcgccccugggcacccccgacuucgucgggaagauccacggcaugcucacccagaccacgcaggagaacggguccacccgggcccaccgcgccaccguguacgugggcagcgccaacuucacccccaagcugggcaagguccaguucgagacggacaccggggacgaccuggccauccggcagaacaccaaguucaccccggugggcgugauccaguccagcgaccaccaccgcgacgagccccagcaguggcggcuccccaacuacuccggggccaacacguucaacguccaccuggcccccgcgguggccccgaacuuccccggcgagcagcuccuguucuuccgcagcacccugcccgggugcggcggccaccccaacauggaccuggacugccuccugccgcaggagugggugcagcacuucuaccaggaggccgcccccgcgcaguccgacgucgcccugcuccgguucgugaaccccgacaccagccgcgugcuguucgagugcaagcugcacaaguccggguacgucaccguggcccacacgggccaguacgaccucgugcugcccagcaacggguacuuccgguucgacuccugggucaaccaguucuacacccuggccccgaugggcaacgggaccggccgccgccgguga

SEQ ID NO: 12737 - RNA, 1614 nt, Artificial Sequence
  derived and/or modified sequence opt1 from VP1__Norovirus_and/or_Norovirus-like__GU598213
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgacuccuggauccgcaacaacuucguccaggcccccgggggcgaguucaccgugagcccgcggaacgcccccggggagauccugugguccgcgccccugggccccgaccucaacccguaccugagccaccuggcccgcauguacaacggcuacgccgggggcuucgaggugcaggucauccucgccgggaacgccuucacggcgggcaagaucaucuucgccgccgugccgcccaacuuccccaccgaggggcugucccccagccaggugaccauguucccccacaucaucgucgacgugcggcagcuggagcccgugcucaucccccugccggacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagccccgacuucgacuucaucuuccucgugccgcccaccguggagucccgcacgaagcccuucaccguccccauccugaccguggaggagaugagcaacucccgguucccgaucccccuggagaagcucuacaccggccccagcuccgccuucgugguccagccccagaacgggcgcugcacgaccgacggcgugcugcuggggaccacccagcucagcgccgucaacaucugcacguuccggggcgacgugacccacaucgccggcucccacgacuacaccaugaaccuggccagccagaacuggagcaacuacgacccgaccgaggagauccccgcgccccuggggacgccggacuucgugggcaagauccaggggaugcucacccagaccacccgcgaggacggcuccacgcgggcccacaaggccaccgucagcaccggguccgugcacuucacccccaagcugggcagcgugcaguacacgaccgacaccaacaacgacuuccagaccggccagaacacgaaguucacccccgucggggugauccaggacggcaacaaccaccagaacgagccccagcagugggugcugccgaacuacuccgggcgcaccggccacaacguccaccucgcccccgccguggcgcccaccuuccccggggagcagcugcuguucuuccggagcacgaugccgggcugcuccggcuaccccaacaugaaccucgacugccugcugccccaggagugggugcagcacuucugccaggaggccgcccccgcccagagcgacgucgcgcuccugcgcuucgugaacccggacaccgggcgggugcuguucgagugcaagcuccacaaguccggcuacgucaccguggcccacaccgggccccacgaccuggugaucccgcccaacggcuacuuccgcuucgacagcugggucaaccaguucuacacccuggcccccauggggaacggcgccggccggcgccgguga

SEQ ID NO: 12738 - RNA, 1614 nt, Artificial Sequence
  derived and/or modified sequence opt1 from VP1__Norovirus_and/or_Norovirus-like__KX514365
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccaucaaccuggagcgccucuucacggggcccagcuccgcgaacgugguccagccgcagaacggccggugcaccaucgacggggagcugcugggcaccacccagcucagcuccgugaacaucugcacguuccgcggcgacgucacccagauccggagcacccagcacuggaccaugaaccuggccagccccaacuggaacaacuacgaccccacggaggagaccccggcgccccuggggacccccgacuucgugggcaagauccacgggaugcucacccagacgacccaggagaacggcuccacccgcgcccaccgggccaccguguacgucgggagcgccaacuucacgcccaagcugggcaaggugcaguucgagaccgacaccggcgacgaccuggccauccgccagaacaccaaguucacgccggugggggucauccaguccagcgaccaccaccgggacgagccccagcaguggcgccuccccaacuacuccggcgccaacaccuucaacgugcaccuggcccccgccguggcgccgaacuuccccggggagcagcuccuguucuuccggagcacccugcccggcugcgggggccaccccaacauggaccuggacugccuccugccgcaggaguggguccagcacuucuaccaggaggccgcccccgcccaguccgacguggcgcugcuccgcuucgugaaccccgacaccagccggguccuguucgagugcaagcugcacaaguccggcuacgugacgguggcccacaccgggcaguacgaccucguccugcccagcaacggcuacuuccgcuucgacuccugggugaaccaguucuacacccuggccccgauggggaacggcaccgggcgccggcgcuga

SEQ ID NO: 12739 - RNA, 1614 nt, Artificial Sequence
  derived and/or modified sequence opt1 from VP1__Norovirus_and/or_Norovirus-like__KX514304
augaagauggugagcaacgacgccaaccccuccgacggcagcgccgcgaaccuggucccggaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucaccgcgggcaagaucaucuucgccgccgugccgcccacguucccgaccgaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaaccccggcgacgacguguucaccgucagcugccgcgugcugacccggccgucccccgacuucgacuucaucuuccucgugccgcccaccgucgagagccgcacgaagcccuucuccgugcccauccugaccgugggcgagaugaccaacagccgguuccccaucaaccuggagcgccucuucaccgggcccuccagcgcgaacgucgugcagccgcagaacggccggugcacgaucgacggggagcugcugggcaccacccagcucuccagcgucaacaucugcaccuuccgcggcgacgugacgcagaucggguccaccaagcacuggaccaugaaccuggccagccccaacuggaacaacuacgaccccaccgaggagacgccggcgccccugggcacccccgacuucguggggaagauccacggcaugcucacccagaccacgcaggagaacgggagcacccgggcccaccgcgccaccgucuacgugggcggcgccaacuucacccccaagcuggggaaggugcaguucgagacggacaccggcgacgaccuggccauccggcagaacaccaaguucaccccggucggggugauccaguccagcgaccaccaccgcgacgagccccagcaguggcggcuccccaacuacuccggcgccaacacguucaacgugcaccuggcccccgccgucgcgccgaacuuccccggggagcagcuccuguucuuccgcagcacccugcccggcugcggcgggcaccccaacauggaccuggacugccuccugccgcaggagugggugcagcacuucuaccaggaggccgcccccgcccaguccgacguggcgcugcuccgguucgucaaccccgacaccagccgcgugcuguucgagugcaagcugcacaaguccggcuacgugaccgucgcccacacggggcaguacgaccucgugcugcccagcaacggcuacuuccgguucgacuccugggugaaccaguucuacacccuggccccgauggggaacggcaccggccgccgccgguga

SEQ ID NO: 12740 - RNA, 1614 nt, Artificial Sequence
  derived and/or modified sequence opt1 from VP1__Norovirus_and/or_Norovirus-like__KX514302
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcagaucgggagcacccagcacuggaccaugaaccuggccagccccaacuggaacaacuacgaccccaccgaggagacgccggcgccccugggcacccccgacuucguggggaagauccacggcaugcucacccagaccacgcaggagaacggguccacccgggcccaccgcgccaccguguacgucggcggcgccaacuucacccccaagcuggggcgggugcaguucgagacggacaccaccgacgaccuggacgcccaccagaacaccaaguucacgccggugggcgucauccagagcuccgaccaccaccgcgacgagccccagcaguggcggcuccccaacuacagcggggccaacaccuucaacgugcaccuggcccccgcgguggccccgaacuuccccggcgagcagcuccuguucuuccgcuccacccugcccgggugcggcggccaccccaacauggaccuggacugccuccugccgcaggaguggguccagcacuucuaccaggaggccgcccccgcgcagagcgacguggcccugcuccgguucgugaaccccgacaccucccgcguccuguucgagugcaagcugcacaagagcggguacgugacgguggcccacaccggccaguacgaccucguccugcccuccaacggguacuuccgguucgacagcugggugaaccaguucuacacccuggccccgaugggcaacgggaccggccgccgccgguga

SEQ ID NO: 12741 - RNA, 1614 nt, Artificial Sequence
  derived and/or modified sequence opt1 from VP1__Norovirus_and/or_Norovirus-like__KX514207
augaagauggccagcuccgacgccaaccccagcgacggcuccgcggccaaccuggugccggaggucaacaacgaggugauggcccucgagcccguggucggggccgccaucaccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccaucaaccuggagcgccucuucacggggcccagcuccgcgaacgugguccagccgcagaacggccggugcaccaucgacggggagcugcugggcaccacccagcucagcuccgugaacaucugcacguuccgcggcgacgucacccacaucgggagcacccaccacuggaccaugaaccuggugagccccaacuggaacaacuacgaccccacggaggagaccccggcgccccugggcacccccgacuucguggggaagauccacggcaugcucacccagacgacccagggguccggcagcacccgggcccaccgcgccaccgucuacgugggcuccgccgaguucacgcccaagcuggggaaggugcaguucaagaccgagaccgaccacgaccugagcauccggcagaacaccaaguucacgccggucggcgugauccaggaguccgaccaccaccgcgacgagccccagcaguggcggcuccccaacuacagcggggccaacgccuucaacgugcaccuggcccccgccgucgccccgaacuuccccggcgagcagcuccuguucuuccgcuccacccugcccgggugcggcggccaccccaacauggaccuggacugccuccugccgcaggagugggugcagcacuucuaccaggaggcggcccccgcccagagcgacguggcccugcuccgguucgucaaccccgacaccucccgcgugcuguucgagugcaagcugcacaagagcggguacgugaccgucgcgcacacgggccaguacgaccucgugcugcccuccaacggguacuuccgguucgacagcugggugaaccaguucuacacccuggccccgaugggcaacgggaccggccgccgccgguga

SEQ ID NO: 12742 - RNA, 1614 nt, Artificial Sequence
  derived and/or modified sequence opt1 from VP1__Norovirus_and/or_Norovirus-like__KX514192
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcacaucggggccacccggcacuggaccaugaaccuggccagccccaacuggaacaacuacgaccccaccgaggagacgccggcgccccugggcacccccgacuucguggggaagauccacggcaugcucacccagaccacgcaggggagcggcuccacccgcgcccaccgggccaccgucuacgugggcagcgccgaguucacccccaagcuggggaaggugcgcuucgagacggacaccgaggacgaccuggucauccggcagaacaccaaguucaccccggugggcgugauccaguccagcgagcaccaccgcgacgagccccagcaguggcggcuccccaacuacuccggggccaacacguucaacguccaccuggcccccgcgguggccccgaacuuccccggcgagcagcuccuguucuuccgcagcacccugcccgggugcggcggccaccccaacauggaccuggacugccuccugccgcaggagugggugcagcacuucuaccaggaggccgcccccgcgcaguccgacgucgcccugcuccgguucgugaaccccgacaccagccgcgugcuguucgagugcaagcugcacaaguccggguacgucaccguggcccacacgggccaguacgaccucgugcugcccagcaacggguacuuccgcuucgacuccugggucaaccaguucuacacccuggccccgaugggcaacgggaccggccggcgccgguga

SEQ ID NO: 12743 - RNA, 1614 nt, Artificial Sequence
  derived and/or modified sequence opt1 from VP1__Norovirus_and/or_Norovirus-like__KF806525
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccuacagccgguuccccaucccccuggagaagcuguucaccggcccguccagcgccuucgucgugcagccccagaacgggcgcugcaccacggacggcguccuccuggggaccacccagcucucccccgugaacaucugcaccuuccggggcgaccugacgcacuucgccggcaccagcgaguacgccaugaaccuggcgucccagaacuggaccaacuacgacccgaccgaggagauccccgcgccccucggggcccccgacuucgugggcaagauccgcgggguccugacgcagaccacccggggcgacgggagcacccgcggccaccgggccacgcugagcaccggcuccgcccacuucaccccgaagcucgggagcgugcgcuucuccaccgacacgaacaacgacuucgaggccggccagaacaccaaguucacccccgugggggucuuccaggacggcgacaaccaccagaacgagccccagcagugggugcugcccaacuacagcggggccaccgcccacaacgugcaccuggccccggcggucgcccccgccuuccccggcgagcagcuccuguucuuccgguccacgaugcccggcugcagcggguacccgaacaugaaccuggacugccuccugccccaggagugggugcagcacuucuaccaggaggccgcccccgcgcaguccgacguggcccugcuccgcuucgucaaccccgacaccagccgggugcuguucgagugcaagcugcacaaguccggcuacgugaccgucgcccacaccgggcagcacgaccucgugaucccgcccaacggcuacuuccgcuucgacagcugggugaaccaguucuacacgcuggcccccauggggaacggcaccggccggcgccgcuga

SEQ ID NO: 12744 - RNA, 1614 nt, Artificial Sequence
  derived and/or modified sequence opt1 from VP1__Norovirus_and/or_Norovirus-like__KC462195
augaagauggccagcaacgacaccauccccuccgacggcagcaccgccaaccuggugccggaggucaacaacgaggugauggcgcucgagcccguggucggggccgccaucgccgcccccguggcgggccagcagaacgugaucgaccccuggauccgcaacaacuucguccaggcccccgggggcgaguucacggugagcccccggaacgcccccggggagauccugugguccaugccccuguccccggaccucaaccccuaccugagccaccugucccgcauguacaacggcuacgccggcggguucgaggugcaggucauccucgcgggcaacgccuucaccgccgggaagaucaucuucgccgccaucccgcccaacuucccgaccgacggccugagccccucccaggugaccauguucccccacaucaucguggacguccggcagcuggagcccgugcucaucccgcugcccgacgugcgcaacaacuucuaccacuacaaccaggucaacgacagcacgcugaagcucaucgcgaugcuguacacgccccugcgggccaacaacgccggggacgacguguucaccguguccugccgcguccucacccggcccagcccggacuucgacuucaucuuccuggugccgcccaccguggagucccgcaccaagcccuucaccguccccauccugaccguggacgagaugacgaacagccgguuccccacgccccucgagcgccugcacaccggccccaacaacucccuggugguccagccgcagaacggccggugcaccaucgacggggugcuccugggcaccacccagcugagcgccgucaacaucugcuccuuccgcggggacagcaccacccgggagggccagucccacgccuacacgaugaaccucgcgagccagaacuggaccaacuacgaccccaccgaggacauccccgccccgcugggcacccccgacuucguggggaagaucgugggcaugcugagccagacgacccgcgagaacuccagcacccgggcccacaaggccaccgucuccacgggggacgcccacuucaugcccaagcucggcagcgugcuguucaccaccgacaccgaggaccugcagaacgggcagaacacgcgcuucacccccgugggcgucgcgcaggacggcgagccgcaccagaacgagccccagcaguggcggcuccccaacuacuccgggacccccggccacaacgugcaccuggccccgcccguggcccccaccuuccccggggagcagcuccuguucuuccgcagcacgaugccgggcugcgggggcuaccccaacauggaccuggacugccugcucccccaggaguggguccggcacuucuaccaggaggccgcccccgcgcaguccgacguggcccugcugcgcuucgugaacccggacaccggccggguccucuucgagugcaagcugcacaaggccggguacaucaccgugagccacaccggccccuacgaccuggugaucccgcccaacggguacuuccgcuucgacuccugggucaaccaguucuacgcccucgcgcccaugggcaccgggacgggccgccggcgcuga

SEQ ID NO: 12745 - RNA, 1614 nt, Artificial Sequence
  derived and/or modified sequence opt1 from VP1__Norovirus_and/or_Norovirus-like__AF427116
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccauccccauccugaccgucgaggagauguccaacagccgguuccccaucccccuggagaagcucuacaccggccccuccagcgccuucguggugcagccgcagaacgggcgcugcacgaccgacggcguccugcuggggaccacccagcucuccgccgugaacaucugcacguuccggggcaacgucauccacaucgccggcagccacgacuacaccaugaaccuggccucccagaacuggaacaacuacgaccccaccgaggagacccccgcgccgcuggggacgagcgacuucgugggcaagauccaggggcuccugacccagaccacccgcgaggacggcagcacgcgggcccacaaggccaccguguccaccgggagcguccacuucacccccaagcugggcuccgugcaguacacgaccgacaccaacaacgacuuccagaccggccagaacacgaaguucacccccgugggggucauccaggacggcaacaaccaccagaacgagccccagcagugggugcucccgaacuacagcgggcgcgccggccacaacgugcaccuggcccccgcggucgcccccaccuuccccggggagcagcuccucuucuuccgguccaccaugccgggcugcagcggcuaccccaacaugaaccuggacugccugcucccccaggagugggugcagcacuucuaccaggaggccgcccccgcgcaguccgacguggcccugcugcgcuucgucaacccggacacggggcgggugcuguucgagugcaagcugcacaagagcggcuacgugaccgucgcccacaccgggccccacgaccuggugaucccgcccaacggcuacuuccgcuucgacuccugggugaaccaguucuacacccucgcccccauggggaacggcgccggccggcgccgguga

SEQ ID NO: 12746 - RNA, 1614 nt, Artificial Sequence
  derived and/or modified sequence opt1 from VP1__Norovirus_and/or_Norovirus-like__KX514337
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccauccugacggugggcgagaugaccaacagccgguuccccgugaaccuggagcgccucuucaccgggcccuccagcgccaacgucgugcagccccagaacggccggugcaccaucgacggggagcugcugggcacgacccagcucuccagcgucaacaucugcaccuuccgcggcgacgugacccagaucggggccacgcggcacuggaccaugaaccuggccuccccgaacuggaacaacuacgaccccaccgaggagacccccgcgccgcugggcacgcccgacuucguggggaagguccacggcaugcucacccagaccacccaggggagcggcagcacgcgcgcccaccgggccaccguguacgugggcggggccgaguucacccccaagcugggcaagguccgcuucgagaccgacacggaggacgaccuggugauccggcagaacaccaaguucacccccgugggggucauccaguccagcgagcaccaccgcgacgagccgcagcaguggcggcuccccaacuacuccggcgccaacaccuucaacgugcaccuggcgcccgccguggcccccaacuucccgggggagcagcuccuguucuuccgcagcacgcugcccggcugcggcgggcaccccaacauggaccuggacugccuccugccccaggaguggguccagcacuucuaccaggaggccgcgccggcccaguccgacguggcccugcuccgguucgugaaccccgacaccagccgcguccuguucgagugcaagcugcacaaguccggcuacgugaccguggcccacaccgggcagcacgaccucgucaucccgcccaacggcuacuuccgcuucgacagcugggugaaccaguucuacacgcuggcccccauggggaacggcaccggccggaagcgcuga

SEQ ID NO: 12747 - RNA, 1614 nt, Artificial Sequence
  derived and/or modified sequence opt1 from VP1__Norovirus_and/or_Norovirus-like__KX514255
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccaucaaccuggagcgccucuucacggggcccagcuccgcgaacgugguccagccgcagaacggccggugcaccaucgacggggagcugcugggcaccacccagcucagcuccgugaacaucugcacguuccgcggcgacgucacccacaucgggagcacccaccacuggaccaugaaccuggccagccccaacuggaacaacuacgaccccacggaggagaccccggcgccccugggcacccccgacuucguggggaagauccacggcaugcucacccagacgacccaggagaacggguccacccgggcccaccgcgccaccguguacgucggcagcgccgacuucacgcccaagcugggcaaggugcaguucgagaccgagaccgacuacgaccuggccauccggcagaacaccaaguucacgccggugggggucauccaggaguccgaccaccaccgcgacgagccccagcaguggcggcuccccaacuacagcggcgccaacaccuucaacgugcaccuggcccccgccguggcgccgaacuuccccggggagcagcuccuguucuuccgcuccacccugcccggcugcgggggccaccccaacauggaccuggacugccuccugccgcaggaguggguccagcacuucuaccaggaggccgcccccgcccagagcgacguggcgcugcuccgguucgugaaccccgacaccucccgcguccuguucgagugcaagcugcacaagagcggcuacgugacgguggcccacaccgggcaguacgaccucguccugcccuccaacggcuacuuccgguucgacagcugggugaaccaguucuacacccuggccccgauggggaacggcaccgggcgccgccgguga

SEQ ID NO: 12748 - RNA, 1614 nt, Artificial Sequence
  derived and/or modified sequence opt1 from VP1__Norovirus_and/or_Norovirus-like__KX514210
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccgucuacgugggcuccgccgaguucacccccaagcuggggaaggugcaguucaagacggagaccgaccacgaccugagcacccggcagaacaccaaguucacgccggucggcgugauccaggaguccgaccaccaccgcgacgagccccagcaguggcggcuccccaacuacagcggggccaacaccuucaacgugcaccuggcccccgccgucgcgccgaacuuccccggcgagcagcuccuguucuuccgcuccacccugcccgggugcggcggccaccccaacauggaccuggacugccuccugccgcaggagugggugcagcacuucuaccaggaggccgcccccgcccagagcgacguggcgcugcuccgguucgucaaccccgacaccucccgcgugcuguucgagugcaagcugcacaagagcggguacgugacggucgcccacaccggccaguacgaccucgugcugcccuccaacggguacuuccgguucgacagcugggugaaccaguucuacacccuggccccgaugggcaacgggaccggccgccgccgguga

SEQ ID NO: 12749 - RNA, 1614 nt, Artificial Sequence
  derived and/or modified sequence opt1 from VP1__Norovirus_and/or_Norovirus-like__KX514182
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcacaucgggaccacccagcacuggaccaugaaccuggccagccccaacuggaacaacuacgaccccacggaggagaccccggcgccccugggcacccccgacuucguggggaagauccacggcaugcucacccagacgacccaggggagcggcuccacccgggcccaccgcgccaccgucuacgugggcagcgccgaguucacgcccaagcuggggaaggugcgguucgagaccgacaccgaggacgaccuggucauccgccagaacaccaaguucacgccggugggcgugauccaguccagcgagcaccaccgggacgagccccagcaguggcgccuccccaacuacuccggggccaacaccuucaacguccaccuggcccccgccguggcgccgaacuuccccggcgagcagcuccuguucuuccggagcacccugcccgggugcggcggccaccccaacauggaccuggacugccuccugccgcaggagugggugcagcacuucuaccaggaggccgcccccgcccaguccgacgucgcgcugcuccgcuucgugaaccccgacaccagccgggugcuguucgagugcaagcugcacaaguccggguacgucacgguggcccacaccggccaguacgaccucgugcugcccagcaacggguacuuccgcuucgacuccugggucaaccaguucuacacccuggccccgaugggcaacgggaccggccgcaagcgguga

SEQ ID NO: 12750 - RNA, 1614 nt, Artificial Sequence
  derived and/or modified sequence opt1 from VP1__Norovirus_and/or_Norovirus-like__AF425764
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcggguucaccgugagcccccggaacgcccccggcgagauccugugguccgcgccccugggcccggaccucaaccccuaccugucccaccuggcccgcauguacaacggguacgccggcggguucgaggugcaggucauccucgccggcagcgccuccacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccaucccccuggagaagcucuacaccgggcccuccagcgccuucgugguccagccgcagaacggccgcugcacgaccgacggggugcugcugggcaccacccagcucuccgccgucaacaucugcacguuccggggcgacgugacccacaucgccgggagccacgacuacaccaugaaccuggccagccagaacuggaacaacuacgaccccaccgaggagauccccgcgccgcugggcacgcccgacuucguggggaagauccagggcaugcucacccagaccacccgcgaggacggguccacgcgggcccacaaggccaccgucagcaccggcuccgugcacuucacccccaagcugggcagcgugcaguacacgaccgacaccaacaacgacuuccagaccgggcagaacacgaaguucacccccgucggcgugauccaggacgggaacaaccaccagaacgagccgcagcagugggugcugcccaacuacuccggccgcaccgggcacaacguccaccucgcccccgccguggcgcccaccuucccgggcgagcagcugcuguucuuccggagcacgaugcccggcugcuccggguaccccaacaugaaccucgacugccugcugccccaggagugggugcagcacuucuaccaggaggccgccccggcccagagcgacgucgcgcuccugcgcuucgugaaccccgacaccggccgggugcuguucgagugcaagcuccacaaguccggguacgucaccguggcccacaccggcccccacgaccuggugaucccgcccaacggguacuuccgcuucgacagcugggucaaccaguucuacacccuggcccccaugggcaacggcgccgggcggcgccgguga

SEQ ID NO: 12751 - RNA, 1614 nt, Artificial Sequence
  derived and/or modified sequence opt1 from VP1__Norovirus_and/or_Norovirus-like__KX514355
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccaucaaccuggagcgccucuucacggggcccagcuccgcgaacgugguccagccgcagaacggccggugcaccaucgacggggagcugcugggcaccacccagcucagcuccgugaacaucugcacguuccgcggcgacgucacccagaucgggagcacccagcacuggaccaugaaccuggccagccccaacuggaacaacuacgaccccacggaggagaccccggcgccccugggcacccccgacuucguggggaagauccacggcaugcucacccagacgacccaggagaacggguccacccgggcccaccgcgccaccguguacgucggcggcgccaacuucacgcccaagcuggggaaggugcaguucgagaccgacaccagcgacgaccuggccauccggcagaacaccaaguucacgccggugggcgucauccaguccagcgaccaccaccgcgacgagccccagcaguggcggcuccccaacuacuccggggccaacaccuucaacgugcaccuggcccccgccguggcgccgaacuuccccggcgagcagcuccuguucuuccgcagcacccugcccgggugcggcggccaccccaacauggaccuggacugccuccugccgcaggaguggguccagcacuucuaccaggaggccgcccccgcccaguccgacguggcgcugcuccgguucgugaaccccgacaccagccgcguccuguucgagugcaagcugcacaaguccggguacgugacgguggcccacaccggccaguacgaccucguccugcccagcaacggguacuuccgguucgacuccugggugaaccaguucuacacccuggccccgaugggcaacgggaccggccgccgccgguga

SEQ ID NO: 12752 - RNA, 1614 nt, Artificial Sequence
  derived and/or modified sequence opt1 from VP1__Norovirus_and/or_Norovirus-like__KX514345
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgucaaccuggagcgccucuucaccggccccagcuccgccaacgugguccagccccagaacgggcggugcaccaucgacggcgagcugcuggggaccacgcagcucagcuccgugaacaucugcaccuuccgcggcgacgugacccagaucggcgccacccggcacuggacgaugaaccuggccagccugaacuggaacaacuacgacccgaccgaggagacccccgcgccccucgggaccccggacuucgucggcaagauccacgggaugcugacgcagaccacccagggcagcggguccacccgcgcccaccgggccacgguguacgugggcgccgccgaguucacccccaagcugggcaagguccgcuucgagaccgacaccgaggacgaccucgugauccggcagaacacgaaguucacccccgugggggucauccagagcuccgagcaccaccgcgacgagccccagcaguggcggcugccgaacuacagcggcgcgaacaccuucaacgugcaccuggcccccgccguggcccccaacuuccccggggagcagcuccuguucuuccgcuccacccugccgggcugcgggggccaccccaacauggaccucgacugccugcugccccaggaguggguccagcacuucuaccaggaggcggcccccgcccagagcgacguggcccuccugcgguucgugaacccggacacgucccgcguccuguucgagugcaagcuccacaagagcggcuacgugaccguggcccacaccgggcaguacgaccugguccugcccuccaacggcuacuuccgcuucgacagcugggugaaccaguucuacacccucgcgcccauggggaacggcacggggcggcgccgguga

SEQ ID NO: 12753 - RNA, 1614 nt, Artificial Sequence
  derived and/or modified sequence opt1 from VP1__Norovirus_and/or_Norovirus-like__KX514204
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccguguacgucggcggggccgaguucacccccaagcugggcaaggugcaguucaagacggagaccgaccacgaccuguccauccggcagaacaccaaguucaccccggugggggucauccaggagagcgaccaccaccgcgacgagccccagcaguggcggcuccccaacuacuccggcgccaacacguucaacgugcaccuggcccccgccguggcgccgaacuuccccggggagcagcuccuguucuuccgcagcacccugcccggcugcggcgggcaccccaacauggaccuggacugccuccugccgcaggaguggguccagcacuucuaccaggaggccgcccccgcccaguccgacguggcgcugcuccgguucgugaaccccgacaccagccgcguccuguucgagugcaagcugcacaaguccggcuacgugaccguggcccacacggggcaguacgaccucguccugcccagcaacggcuacuuccgguucgacuccugggugaaccaguucuacacccuggccccgauggggaacggcaccggccgccgccgguga

SEQ ID NO: 12754 - RNA, 1614 nt, Artificial Sequence
  derived and/or modified sequence opt1 from VP1__Norovirus_and/or_Norovirus-like__KF712492
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucgccgccggcaagaucaucuucgccgccgugccgcccaacuucccgacggaggggcugagccccucccaggugaccauguucccccaccugaucguggacguccggcagcucgagcccgugaugaucccgcugcccgacauccgcaacaacuucuaccacuacaaccagagcaacgaccccaccaucaagcugaucgccaugcucuacacgccccugcgggcgaacaacgugggcgacgacgucuucaccguguccugccgcgugcugacccggccgagccccgacuucgacuucaucuuccucgucccgcccaccguggaguccaagaccaaccccuucagcgugcccauccugacgaucgaggagaugaccaacucccgcuuccccaucccccuggagaagcuguucaccggcccgagcuccgcccucgucgugcagccccagaacgggcggugcaccacggacggcgugcugcucgggaccacccagcugagccccgucaacaucugcaccuuccgcggcgacgugacgcacaccaccaagacccacacguaccagaugaaccuggccgcccagaacuggaacuccuacgacccgaccgaggagauccccgcgccccucggcacccccgacuucgucgggaagauccagggcgugcugacccagacgaccaaggggaacggcagcacccgggcccacaaggccaccguguacacggggagcgccgaguucaccccgaagcugggccgcauccagcuguucaccgacaccgacaacgaccucgaggccaaccagaacacgaaguucacccccgucggcgugauccaggacggggacacccaccagaacgagccccagcagugggugcugcccuccuacagcggccggaacaaccacaacguccaccucgccccggcgguggcccccaccuuccccggggagcagcugcuguucuuccgcuccacgaugcccggcugcagcggguacccgaacaugaaccucgacugccugcugccccaggagugggugcaguacuucuaccaggaggccgcccccgcgcaguccgacgucgcccuccugcgguucgugaaccccgacaccggccgcgugcuguucgagugcaagcuccacaagagcggcuacgucaccguggcccacaccgggcaccacgaccuguucaucccgcccaacggcuacuuccgguucgacuccugggugagccccuucuacacccuggcccccauggggaacggcacggggcgccggcgcuga

SEQ ID NO: 12755 - RNA, 1614 nt, Artificial Sequence
  derived and/or modified sequence opt1 from VP1__Norovirus_and/or_Norovirus-like__DQ078829
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccccucccaccuggcccgcauguacaacggcuacgccgggggcuucgaggugcaggucauccuggccgggaacgccuucaccgccggcaagaucaucuucgccgccgugcccccgaacuuccccacggaggggcucagccccucccaggugaccauguucccccacaucaucgucgacgugcggcagcuggacccggugcugauccccagccccgacguccgcaacaacuucuaccacuacaaccaguccaacgacagcaccaucaagcucaucgccaugcuguacacgccccugcgggcgaacaacgccggcgacgacguguucaccguguccugccgcguccucacccggccgagccccgacuucgacuucaucuuccuggugccgcccaccguggagucccgcaccaagccguucacgguccccauccugaccguggaggagaugagcaacucccgguuccccaucccccucgagaagcuguacaccggcccgagcuccgccuucgugguccagccccagaacgggcgcugcaccacggacggcgugcugcucgggaccacccagcugagcgccgucaacaucugcaccuuccggggcgacgugacgcacaucgccggcucccacgacuacaccaugaaccuggcgagccagaacuggaucaacuacgaccccaccgaggagaucccggcgccccucgggacccccgacuucgugggcaagauccaggggaugcugacgcagaccacccgcgaggacggcagcacccgggcccacaaggccacggucuccaccgggagcgugcacuucacccccaagcugggcuccgugcaguacaccacggacaccaacaacgacuuccagaccggccaggacaccaaguucacgccggucggggugauccaggacggcaacaaccaccagaacgagccccagcagugggugcuccccaacuacagcgggcgcaccggccacaacguccaccuggcccccgccguggccccgaccuuccccggggagcagcuccuguucuuccgguccaccaugcccggcugcagcggcuaccccaacaugaaccuggacugccugcucccgcaggagugggugcagcacuucuaccaggaggccgcccccgcgcagcccgacgucgcccugcugcgcuucgugaaccccgacacggggcggguccucuucgagugcaagcugcacaaguccggcuacgugaccguggcccacaccgggccgcacgaccuggugaucccgcccaacggcuacuuccgcuucgacagcugggucaaccaguucuacacccucgcccccauggggaacggcgccggccggcgccgguga

SEQ ID NO: 12756 - RNA, 1614 nt, Artificial Sequence
  derived and/or modified sequence opt1 from VP1__Norovirus_and/or_Norovirus-like__KX514370
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccgugaaccuggagcgccucuucaccgggcccuccagcgccaacgucgugcagccgcagaacggccggugcacgaucgacggggagcugcugggcaccacccagcucuccagcgucaacaucugcaccuuccgcggcgacgugacgcagaucggggccacccggcacuggaccaugaaccuggccucccccaacuggaacaacuacgaccccaccgaggagacgccggcgccccugggcacccccgacuucguggggaagauccacggcaugcucacccagaccacgcaggggagcggcagcacccgcgcccaccgggccaccgucuacgugggcggggccgaguucacccccaagcugggcaaggugcgcuucgagacggacaccgaggacgaccuggucauccggcagaacaccaaguucaccccggugggggugauccaguccagcgagcaccaccgcgacgagccccagcaguggcggcuccccaacuacuccggcgccaacacguucaacguccaccuggcccccgcgguggccccgaacuuccccggggagcagcuccuguucuuccgcagcacccugcccggcugcggcgggcaccccaacauggaccuggacugccuccugccgcaggagugggugcagcacuucuaccaggaggccgcccccgcgcaguccgacgucgcccugcuccgguucgugaaccccgacaccagccgcgugcuguucgagugcaagcugcacaaguccggcuacgucaccguggcccacacggggcaguacgaccucgugcugcccagcaacggcuacuuccgcuucgacuccugggucaaccaguucuacacccuggccccgauggggaacggcaccggccggcgccgguga

SEQ ID NO: 12757 - RNA, 1614 nt, Artificial Sequence
  derived and/or modified sequence opt1 from VP1__Norovirus_and/or_Norovirus-like__KX514332
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccaucaaccuggagcgccucuucacggggcccagcuccgcgaacgugguccagccgcagaacggccggugcaccaucgacggggagcugcugggcaccacccagcucagcuccgugaacaucugcacguuccgcggcgacgucacccagaucgggagcaccaagcacuggaccaugaaccuggccagccccaacuggaacaacuacgaccccacggaggagaccccggcgccccugggcacccccgacuucguggggaagauccacggcaugcucacccagacgacccaggagaacggguccacccgggcccaccgcgccaccguguacgucggcggcgccaacuucacgcccaagcuggggaaggugcaguucgagaccgacaccguggacgaccuggagauccggcagaacaccaaguucacgccggucggcgugauccagagcuccgaccaccaccgcgacgagccccagcaguggcggcuccccaacuacagcggggccaacaccuucaacgugcaccuggcccccgccgucgccccgaacuuccccggcgagcagcuccuguucuuccgcuccacccugcccgggugcggcggccaccccaacauggaccuggacugccuccugccgcaggagugggugcagcacuucuaccaggaggcggcccccgcccagagcgacguggcccugcuccgguucgucaaccccgacaccucccgcgugcuguucgagugcaagcugcacaagagcggguacgugacggucgcgcacaccggccaguacgaccucgugcugcccuccaacggguacuuccgguucgacagcugggugaaccaguucuacacccuggccccgaugggcaacgggaccggccgccgccgguga

SEQ ID NO: 12758 - RNA, 1614 nt, Artificial Sequence
  derived and/or modified sequence opt1 from VP1__Norovirus_and/or_Norovirus-like__KX514276
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcacaucgggaccacccaccacuggaccaugaaccuggccagccccaacuggaacaacuacgaccccacggaggagaccccggcgccccugggcacccccgacuucguggggaagauccacggcaugcucacccagacgacccaggggagcggcuccacccgggcccaccgcgccaccgucuacgugggcagcgccgaguucacgcccaagcuggggaaggugcgguucgagaccgacaccgaggacgaccuggucauccgccagaacaccaaguucacgccggugggcgugauccaguccagcgaccaccaccgggacgagccccagcaguggcgccuccccaacuacuccggggccaacaccuucaacguccaccuggcccccgccguggcgccgaacuuccccggcgagcagcuccuguucuuccggagcacccugcccgggugcggcggccaccccaacauggaccuggacugccuccugccgcaggagugggugcagcacuucuaccaggaggccgcccccgcccaguccgacgucgcgcugcuccgcuucgugaaccccgacaccagccgggugcuguucgagugcaagcugcacaaguccggguacgucacgguggcccacaccggccaguacgaccucgugcugcccagcaacggguacuuccgcuucgacuccugggucaaccaguucuacacccuggccccgaugggcaacgggaccggccgccggcgcuga

SEQ ID NO: 12759 - RNA, 1614 nt, Artificial Sequence
  derived and/or modified sequence opt1 from VP1__Norovirus_and/or_Norovirus-like__KX514256
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggaggggcuguucaccggccccagcuccgccaacgugguccagccgcagaacgggcgcugcacgaucgacggcgagcugcugggcaccacccagcucagcuccgugaacaucugcaccuuccgcggggacgucacgcacaucggcagcacccaccacuggaccaugaaccuggccagccccaacuggaacuccuacgaccccaccgaggagacgccggcgccccuggggacccccgacuucgugggcaagauccacgggaugcucacccagaccacgcagggcagcggcuccacccgggcccaccgggccaccguguacgucgggagcgccgaguucacccccaagcugggcaaggugcaguucaagacggagaccaaccacgaccuguccauccgccagaacaccaaguucaccccggugggggucauccaggagagcgaccaccaccgggacgagccccagcaguggcgccuccccaacuacuccggcgccaacacguucaacgugcaccuggcccccgccguggcgccgaacuuccccggggagcagcuccucuucuuccggagcacccugcccggcugcggcgggcaccccaacauggaccuggacugccuccugccgcaggaguggguccagcacuucuaccaggaggccgcccccgcccaguccgacguggcgcugcuccgcuucgugaaccccgacaccagccggguccuguucgagugcaagcugcacaaguccggcuacgugaccguggcccacacggggcaguacgaccucguccugcccccgaacggcuacuuccgcuucgacagcugggugaaccaguucuacacccuggcccccauggggaacggcaccggccggcgccgcuga

SEQ ID NO: 12760 - RNA, 1614 nt, Artificial Sequence
  derived and/or modified sequence opt1 from VP1__Norovirus_and/or_Norovirus-like__KX514209
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgaccucaucuuccuggugccgcccaccguggagucccgcacgaagcccuucagcguccccauccugaccgugggcgagaugaccaacucccgguuccccgugaaccucgagcgccuguucaccgggcccagcuccgccaacgucgugcagccgcagaacggccggugcacgaucgacggggagcugcucggcaccacccagcugagcuccgucaacaucugcaccuuccgcggcgacgugacgcacaucgggagcacccaccacuggaccaugaaccuggccagccccaacuggaacaacuacgaccccaccgaggagacgccggcgccccucggcacccccgacuucguggggaagauccacggcaugcugacccagaccacgcagggguccggcagcacccgggcccaccgcgccaccgucuacgugggcuccgccgaguucacccccaagcuggggaaggugcaguucaagacggagaccgaccacgaccucagcauccggcagaacaccaaguucaccccggucggcgugauccaggaguccgaccaccaccgcgacgagccccagcaguggcggcugcccaacuacagcggggccaacacguucaacgugcaccuggcccccgccgucgcgccgaacuuccccggcgagcagcuccuguucuuccgcuccacccugcccgggugcggcggccaccccaacauggaccucgacugccugcugccgcaggagugggugcagcacuucuaccaggaggccgcccccgcccagagcgacguggcgcuccugcgguucgucaaccccgacaccucccgcgugcuguucgagugcaagcuccacaagagcggguacgugaccgucgcccacacgggccaguacgaccuggugcugcccuccaacggguacuuccgguucgacagcugggugaaccaguucuacacccucgccccgaugggcaacgggaccggccgccgccgguga

SEQ ID NO: 12761 - RNA, 1614 nt, Artificial Sequence
  derived and/or modified sequence opt1 from VP1__Norovirus_and/or_Norovirus-like__KX514205
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccguguacgucggcggggccgaguucacccccaagcugggcaaggugcaguucaagacggagaccgaccacgaccuguccauccggcagaacaccaaguucaccccggugggggucauccaggagagcgaccaccaccgcgacgagccccagcaguggcggcuccccaacuacuccggcgccaacacguucaacgugcaccuggcccccgccguggcgccgaacuuccccggggagcagcuccuguucuuccgcagcacccugcccggcugcggcgggcaccccaacauggaccuggacugccuccugccgcaggaguggguccagcacuucuaccaggaggccgcccccgcccaguccgacguggcgcugcuccgguucgugaaccccgacaccagccgcguccuguucgagugcaagcugcacaaguccggcuacgugaccguggcccacacggggcagcacgaccucgucaucccgcccaacggcuacuuccgguucgacagcugggugaaccaguucuacacccuggcccccauggggaacggcaccggccgccgccgguga

SEQ ID NO: 12762 - RNA, 1614 nt, Artificial Sequence
  derived and/or modified sequence opt1 from VP1__Norovirus_and/or_Norovirus-like__KX514200
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagccccgugaacaucugcaccuuccgcggcgacgucacgcacaucgggaccacccggcacuggaccaugaaccuggccucccccaacuggaacaacuacgacccgacggaggagacccccgcgccccugggcacccccgacuucguggggaagauccacggcaugcucacccagacgacccaggggagcggcagcacccgcgcccaccgggccaccguguacgucggcuccgccgaguucacgccgaagcuggggaaggugcaguucaagaccgagaccgaccacgaccugagcauccgccagaacaccaaguucacgcccgugggcgucauccagaaguccgaccaccaccgggacgagccccagcaguggcgccuccccaacuacagcggggccaacaccuucaacgugcaccuggccccggccguggcgcccaacuuccccggcgagcagcuccuguucuuccgguccacccugcccgggugcggcggccacccgaacauggaccuggacugccuccugccccaggaguggguccagcacuucuaccaggaggccgcccccgcccagagcgacguggcgcugcuccgcuucgugaaccccgacaccucccggguccuguucgagugcaagcugcacaagagcggguacgugacgguggcccacaccggccaguacgaccucguccugccguccaacggguacuuccgcuucgacagcugggugaaccaguucuacacccuggcccccaugggcaacgggaccggccgccggcgcuga

SEQ ID NO: 12763 - RNA, 1614 nt, Artificial Sequence
  derived and/or modified sequence opt1 from VP1__Norovirus_and/or_Norovirus-like__KX514196
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacguguucaccgccggcaagaucaucuucgccgccgugccgcccacguucccgaccgaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggccaacaaccccggcgacgacguguucaccgucuccugccgcgugcugacccggccgagccccgacuucgacuucaucuuccucgugccgcccaccgucgagucccgcacgaagcccuucagcgugcccauccugaccgugggcgagaugaccaacucccgguuccccaucaaccuggagcgccucuucaccgggcccagcuccgcgaacgucgugcagccgcagaacggccggugcacgaucgacggggagcugcugggcaccacccagcucagcuccgucaacaucugcaccuuccgcggcgacgugacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccgucuacgugggcggggccgaguucacccccaagcugggcaaggugcaguucaagacggagaccgaccacgaccugaccauccggcagaacaccaaguucacgccggucggggugauccaggaguccgaccaccaccgcgacgagccccagcaguggcggcuccccaacuacagcggcgccaacaccuucaacgugcaccuggcccccgccgucgccccgaacuuccccggggagcagcuccuguucuuccgcuccacccugcccggcugcggcgggcaccccaacauggaccuggacugccuccugccgcaggagugggugcagcacuucuaccaggaggcggcccccgcccagagcgacguggcccugcuccgguucgucaaccccgacaccucccgcgugcuguucgagugcaagcugcacaagagcggcuacgugacggucgcgcacaccgggcaguacgaccucgugcugcccuccaacggcuacuuccgguucgacagcugggugaaccaguucuacacccuggccccgauggggaacggcaccggccgccgccgguga

SEQ ID NO: 12764 - RNA, 1614 nt, Artificial Sequence
  derived and/or modified sequence opt1 from VP1__Norovirus_and/or_Norovirus-like__AB985437
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccugagccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucaucguggacgugcggcagcuggagcccguccucaucccgcugcccgacgugcgcaacaacuucuaccacuacaaccaggcccacgacuccacccugaagcucaucgccaugcuguacacgccccugcgggcgaacaacgccggcgacgacguguucaccgucagcugccgcgugcucacccggcccuccccggacuucgacuucaucuuccuggugccgcccaccgucgagagccgcaccaagcccuucacggugcccauccugaccguggaggagauguccaacagccgguuccccaucccccucgagaagcuguacaccggccccuccagcgccuucgucgugcagccgcagaacgggcgcugcaccacggacggcguccugcucgggaccacccagcuguccgccgugaacaucugcaacuuccggggcgacgugacccacaucgucggcagccacgacuacacgaugaaccuggugucccagaacuggaacaacuacgaccccaccgaggagauccccgccccgcucgggacccccgacuucgugggcaagauccaggggcugcugacccagacgacccgcgcggacggcagcacccgggcccacaaggccaccgucagcacgggguccgugcacuucacccccaagcucggcagcgugcaguucaccaccgacacgaacaacgacuuccagaccggccagaacaccaaguucacccccgucggggugauccaggacggcgaccaccaccagaacgagccgcagcagugggugcugcccaacuacuccgggacgagcggccacaacguccaccuggcccccgccguggcgcccaccuucccgggggagcagcuccuguucuuccgcuccaccaugcccggcugcagcggcuaccccaacaugaaccuggacugccuccugccccaggagugggugcugcacuucuaccaggaggccgccccggcccaguccgacgucgcgcuccugcgguucgugaaccccgacaccgggcgcgugcuguucgagugcaagcuccacaagagcuccuacaucacggucgcccacaccggccccuacgaccuggugaucccgcccaacggguacuuccgguucgacagcugggugaaccacuucuacacccuggcccccaugggcaacgggaccggcggccgccgguga

SEQ ID NO: 12765 - RNA, 1614 nt, Artificial Sequence
  derived and/or modified sequence opt1 from VP1__Norovirus_and/or_Norovirus-like__KF712494
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggaggugcugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucccgacggaggggcugucccccagccaggugaccauguucccccaccugaucaucgacguccggcagcucgagcccgugaugaucccgcugcccgacgugcgcaacaacuucuaccacuacaaccaguccaacgaccccaccaucaagcugaucgcgaugcucuacacgccccugcgggccaacaacgucggcgacgacguguucaccgugagcugccgcguccugacccggccgucccccgacuucgacuucaucuuccucgugccgcccaccguggagagcaagaccaaccccuucuccguccccauccugacgaucgaggagaugaccaacagccgcuuccccaucccccuggagaagcuguucaccggcccguccagcgcccugguggugcagccccagaacgggcggugcaccacggacggcguccugcucgggaccacccagcugucccccgugaacaucugcaccuuccgcggcgacgucacgcacaucaccaagacccacagcuaccagaugaaccuggccgcccagaacuggaacuccuacgacccgaccgaggagauccccgcgccccucggcacgcccgacuucguggggaagauccagggcgugcugacccagaccaccaaggggaacggcagcacgcgggcccacaaggccaccgucuacaccgggagcaccgaguucacgccgaagcugggccgcauccagcucgugaccgacaccgacaacgaccuggagaccaaccagaacacgaaguucacccccgugggcgucauccaggacggggacacccaccagaacgagccccagcagugggugcugcccuccuaccucggccggaacaaccacaacgugcaccuggccccggccgucgcgcccaccuuccccggggagcagcuccucuucuuccgcagcacgaugcccggcugcuccggguacccgaacaugaaccuggacugccugcucccccaggagugggugcaguacuucuaccaggaggccgcccccgcccagagcgacguggcgcugcugcgguucgucaaccccgacaccggccgcguccucuucgagugcaagcugcacaaguccggcuacgugaccguggcccacaccgggcaccacgaccuguucaucccgcccaacggcuacuuccgguucgacagcugggugucccccuucuacacccucgcccccauggggaacggcacggggcgccggcgcuga

SEQ ID NO: 12766 - RNA, 1614 nt, Artificial Sequence
  derived and/or modified sequence opt1 from VP1__Norovirus_and/or_Norovirus-like__KX514315
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgcgaacgugguccagccgcagaacggccggugcacgaucgacggggagcugcugggcaccacccagcucagcuccgugaacaucugcaccuuccgcggcgacgucacgcagaucgggagcaccaagcacuggaccaugaaccuggccagccccaacuggaacaacuacgaccccaccgaggagacgccggcgccccugggcacccccgacuucguggggaagauccacggcaugcucacccagaccacgcaggagaacggguccacccgggcccaccgcgccaccguguacgucggcggcgccaacuucacccccaagcuggggaaggugcaguucgagacggacaccggcgacgaccuggccauccggcagaacaccaaguucaccccggugggggucauccagagcuccgaccaccaccgcgacgagccccagcaguggcggcuccccaacuacagcggcgccaacacguucaacgugcaccuggcccccgccguggcgccgaacuuccccggggagcagcuccuguucuuccgcuccacccugcccggcugcggcgggcaccccaacauggaccuggacugccuccugccgcaggaguggguccagcacuucuaccaggaggccgcccccgcccagagcgacguggcgcugcuccgguucgugaaccccgacaccucccgcguccuguucgagugcaagcugcacaagagcggcuacgugaccguggcccacacggggcaguacgaccucguccugcccuccaacggcuacuuccgguucgacagcugggugaaccaguucuacacccuggccccgauggggaacggcaccggccgccgccgguga

SEQ ID NO: 12767 - RNA, 1614 nt, Artificial Sequence
  derived and/or modified sequence opt1 from VP1__Norovirus_and/or_Norovirus-like__KX514199
augaagauggccagcuccgacgccaaccccagcgacggcuccgcggccaaccuggugccggaggucaacaacgaggugauggcccucgagcccguggucggggccgccaucguggcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgcgggcaagaucaucuucgccgccgugccgcccacguucccgaccgaggggcugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggccaacaaccccggcgacgacguguucaccgucuccugccgcgugcugacccggccgagccccgacuucgacuucaucuuccucgugccgcccaccgucgagucccgcacgaagcccuucagcgugcccauccugaccgugggcgagaugaccaacucccgguuccccaucaaccuggagcgccucuucaccgggcccagcuccgcgaacgucgugcagccgcagaacggccggugcacgaucgacggggagcugcugggcaccacccagcucagcuccgucaacaucugcaccuuccgcggcgacgugacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccgucuacgugggcuccgccgaguucacccccaagcuggggaaggugcaguucaagacggagaccgaccacgaccugaccauccggcagaacaccaaguucacgccggucggcgugauccaggagagcgaccaccaccgcgacgagccccagcaguggcggcuccccaacuacuccggggccaacaccuucaacgugcaccuggcccccgccgucgccccgaacuuccccggcgagcagcuccuguucuuccgcagcacccugcccgggugcggcggccaccccaacauggaccuggacugccuccugccgcaggagugggugcugcacuucuaccaggaggcggcccccgcccaguccgacguggcccuccugcgguucgucaaccccgacaccagccgcgugcuguucgagugcaagcuccacaaguccggguacgugacggucgcgcacaccggccaguacgaccuggugcugcccagcaacggguacuuccgguucgacuccugggugaaccaguucuacacccucgccccgaugggcaacgggaccggccgccgccgguga

SEQ ID NO: 12768 - RNA, 1614 nt, Artificial Sequence
  derived and/or modified sequence opt1 from VP1__Norovirus_and/or_Norovirus-like__KX514176
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcggaucgggaccacccagcacuggaccaugaaccuggccagccccaacuggaacaacuacgaccccacggaggagaccccggcgccccugggcacccccgacuucguggggaagauccacggcaugcucacccagacgacccaggggagcggcuccacccgcgcccaccgggccaccgucuacgugggcagcgccgaguucacgcccaagcuggggaaggugcgcuucgagaccgacaccgaggacgaccuggucauccggcagaacaccaaguucacgccggugggcgugauccaguccagcgagcaccaccgcgacgagccccagcaguggcggcuccccaacuacuccggggccaacaccuucaacguccaccuggcccccgccguggcgccgaacuuccccggcgagcagcuccuguucuuccgcagcacccugcccgggugcggcggccaccccaacauggaccuggacugccuccugccgcaggagugggugcagcacuucuaccaggaggccgcccccgcccaguccgacgucgcgcugcuccgguucgugaaccccgacaccagccgcgugcuguucgagugcaagcugcacaaguccggguacgucacgguggcccacaccggccaguacgaccucgugcugcccagcaacggguacuuccgcuucgacuccugggucaaccaguucuacacccuggccccgaugggcaacgggaccggccggcgccgguga

SEQ ID NO: 12769 - RNA, 1614 nt, Artificial Sequence
  derived and/or modified sequence opt1 from VP1__Norovirus_and/or_Norovirus-like__KX514360
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccaucaaccuggagcgccucuucacggggcccagcuccgcgaacgugguccagccgcagaacggccggugcaccaucgacggggagcugcugggcaccacccagcucagcuccgugaacaucugcacguuccgcggcgacgucacccagaucgggagcaccaagcacuggaccaugaaccuggccagccccaacuggaacaacuacgaccccacggaggagaccccggcgccccugggcacccccgacuucguggggaagauccacggcaugcucacccagacgacccaggagaacggguccacccgggcccaccgcgccaccguguacgucggcggcgccaacuucacgcccaagcuggggaaggugcaguucgagaccgacaccggcgacgaccuggccauccggcagaacaccaaguucacgccggugggggucauccagagcuccgaccaccaccgcgacgagccccagcaguggcggcuccccaacuacagcggcgccaacaccuucaacgugcaccuggcccccgccguggcgccgaacuuccccggggagcagcuccuguucuuccgcuccacccugcccggcugcggcgggcaccccaacauggaccuggacugccuccugccgcaggaguggguccagcacuucuaccaggaggccgcccccgcccagagcgacguggcgcugcuccgguucgugaaccccgacaccucccgcguccuguucgagugcaagcugcacaagagcggcuacgugacgguggcccacaccgggcaguacgaccucguccugcccuccaacggcuacuuccgguucgacagcugggugaaccaguucuacacccuggccccgauggggaacggcaccggccgccgccgguga

SEQ ID NO: 12770 - RNA, 1614 nt, Artificial Sequence
  derived and/or modified sequence opt1 from VP1__Norovirus_and/or_Norovirus-like__KX514347
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccaguccggcaacacgaagaucuacaccaugaaccuggccagccccaacuggaacaacuacgaccccaccgaggagaucccggcgccccuggggacccccgacuucgucggcaagauccacgggaugcucacgcagaccacccagggcagcggguccacccgcgcccaccgggccacgguguacgugggcggcgccgaguucacccccaagcuggggaagguccgcuucgagaccgacaccgaggacgaccuggugauccggcagaacacgaaguucaccccggugggcgucauccagagcuccgagcaccaccgcgacgagccccagcaguggcggcuccccaacuacagcggggccaacaccuucaacgugcaccuggcccccgcgguggccccgaacuuccccggcgagcagcuccucuucuuccgcuccacccugcccgggugcggcggccaccccaacauggaccuggacugccuccugccgcaggaguggguccagcacuucuaccaggaggccgcccccgcgcagagcgacguggcccugcuccgguucgugaaccccgacacgucccgcguccuguucgagugcaagcugcacaagagcggguacgugaccguggcccacaccggccagcacgaccucguccugcccuccaacggguacuuccgguucgacagcugggugaaccaguucuacacccuggccccgaugggcaacgggacgggccgccgccgguga

SEQ ID NO: 12771 - RNA, 1614 nt, Artificial Sequence
  derived and/or modified sequence opt1 from VP1__Norovirus_and/or_Norovirus-like__AB684675
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccaggcccacgacagcacccugaagcucaucgccaugcuguacacgccccugcgggcgaacaacgccggcgacgacguguucaccguguccugccgcguccucacccggcccagcccggacuucgacuucaucuuccuggugccgcccaccguggagucccgcaccaagcccuucacgguccccauccugaccguggaggagaugagcaacucccgguuccccaucccccucgagaagcuguacaccggccccagcuccgccuucgugguccagccgcagaacgggcgcugcaccacggacggcgugcugcucgggaccacccagcugagcgccgucaacaucugcaacuuccugggcgacgugacccgggugggcacgucccacgacuacaccaugaaccucgucagccagaacugggacaacuacgaccccaccgaggagauccccgccccgcuggggacccccgacuucgugggcaagauccaggggcugcucacgcagaccacccgcgcggaccggagcacccccgcccacaaggccacgguguccaccggcagcguccacuucacccccaagcugggguccgugcaguucaccacggacaccaacaacgacuuccagaccggccagaacaccaaguucacgccggugggcgucauccaggacagcgaccaccaccagaacgagccccagcagugggugcugcccaacuacuccgggaccaccggccacaacgugcaccucgcccccgccgucgcgccgaccuuccccggggagcagcugcuguucuuccgcgugacgaugcccggcugcagcggguaccccaacaugaaccucgacugccugcugccgcaggagugggugcuccacuucuaccaggaggccgcccccgcccaguccgacgucgcgcugcugcgguucgugaaccccgacaccggccgcguccucuucgagugcaagcugcacaagagcggcuacaucaccguggcccacaccgggcccuacgaccuggugaucccgcccaacggcuacuuccgguucgacuccugggugaaccaguucuacacccucgcccccauggggaacggcacggggcgccggcgcuga

SEQ ID NO: 12772 - RNA, 1614 nt, Artificial Sequence
  derived and/or modified sequence opt1 from VP1__Norovirus_and/or_Norovirus-like__KX514369
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcagaucggggccacccggcacuggaccaugaaccuggccagccccaacuggaacaacuacgaccccaccgaggagacgccggcgccccugggcacccccgacuucguggggaagauccacggcaugcucacccagaccacgcaggggagcggcuccacccgcgcccaccgggccaccgucuacgugggcggggccgaguucacccccaagcugggcaaggugcgcuucgagacggacaccgaggacgaccuggucauccggcagaacaccaaguucaccccggugggggugauccagagcuccgagcaccaccgcgacgagccccagcaguggcggcuccccaacuacagcggcgccaacacguucaacguccaccuggcccccgcgguggccccgaacuuccccggggagcagcuccuguucuuccgcuccacccugcccggcugcggcgggcaccccaacauggaccuggacugccuccugccgcaggagugggugcagcacuucuaccaggaggccgcccccgcgcagagcgacgucgcccugcuccgguucgugaaccccgacaccucccgcgugcuguucgagugcaagcugcacaagagcggcuacgucaccguggcccacacggggcaguacgaccucgugcugcccuccaacggcuacuuccgcuucgacagcugggucaaccaguucuacacccuggccccgauggggaacggcaccggccggcgccgguga

SEQ ID NO: 12773 - RNA, 1614 nt, Artificial Sequence
  derived and/or modified sequence opt1 from VP1__Norovirus_and/or_Norovirus-like__KX514310
augaagauggccagcaacgacaccaaccccuccgacggcagcgccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcuccaagcccuucagcguccccgugcugacgguggaggagaugaccaacucccgguuccccgccacccuggacaagcuguucaccggccccagcuccacguucgucgugcagccccagaacgggcgcugcaugaucgacggcguccugcuggggaccacccagcucagcccggugaacaucugcaccuuccggggcgacgugacgcacccccgcgacuccaagaucuacaccaugaaccuggccagccccaacuggaacaacuacgacccgaccgaggagauccccgcgccccugggcacccccgacuucgucgggaagauccacggcaugcucacgcagaccacccaggagaacgggagcacccgggcccaccgcgccacgguguacgugggcggggccaacuucaccccgaagcugggcaagguccaguucgagaccgacaccggcgacgaccuggccauccggcagaacacgaaguucacccccgugggggugauccaguccagcgaccaccaccgcgacgagccccagcaguggcggcuccccaacuacuccggcgccaacaccuucaacguccaccuggccccggcgguggcccccaccuuccccggggagcagcuccucuucuuccgcagcacgauccccggcugcgggggccacccgaacaugaaccuggacugccugcucccccaggagugggugcagcacuucuaccaggaggccgcccccgcgcaguccgacgucgcccugcugcgguucgugaaccccgacaccagccgcguccucuucgagugcaagcugcacaaguccggcuacgugaccguggcccacaccgggcaguacgaccuggugcucccgagcaacggcuacuuccgguucgacuccugggucaaccaguucuacacgcuggcccccauggggaacggcaccgggcgccgccgguga

SEQ ID NO: 12774 - RNA, 1614 nt, Artificial Sequence
  derived and/or modified sequence opt1 from VP1__Norovirus_and/or_Norovirus-like__KX514185
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccgugaaccuggagcgccucuucaccgggcccagcuccgccaacgucgugcagccgcagaacggccggugcacgaucgacgggggccugcugggcaccacccagcucagcuccgucaacaucugcaccuuccgcggggacgugacgcacaucggcaccacccggcacuggaccaugaaccuggccagccccaacuggaacaacuacgaccccacggaggagaccccggcgccccuggggacccccgacuucgugggcaagauccacgggaugcucacccagacgacccagggcagcggcuccacccgcgcccaccgggccaccgucuacguggggagcgccgaguucacgcccaagcugggcaaggugcgcuucgagaccgacaccgaggacgaccuggucauccggcagaacaccaaguucacgccggugggggugauccaguccagcgagcaccaccgcgacgagccccagcaguggcggcuccccaacuacuccggcgccaacaccuucaacguccaccuggcccccgccguggcgccgaacuuccccggggagcagcuccuguucuuccgcagcacccugcccggcugcggcgggcaccccaacauggaccuggacugccuccugccgcaggagugggugcagcacuucuaccaggaggccgcccccgcccaguccgacgucgcgcugcuccgguucgugaaccccgacaccagccgcgugcuguucgagugcaagcugcacaaguccggcuacgucacgguggcccacaccgggcaguacgaccucgugcugcccagcaacggcuacuuccgcuucgacuccugggucaaccaguucuacacccuggccccgauggggaacggcaccggccggcgccgguga

SEQ ID NO: 12775 - RNA, 1614 nt, Artificial Sequence
  derived and/or modified sequence opt1 from VP1__Norovirus_and/or_Norovirus-like__KX514181
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcaguucagcguccccauccugaccgugggcgagaugaccaacucccgguuccccgugaaccuggagcgccucuucaccgggcccagcuccgccaacgucgugcagccccagaacggccggugcacgaucgacggggagcugcugggcaccacccagcucagcuccgucaacaucugcaccuuccgcggcgacgugacgcacaucgggaccacccggcacuggaccaugaaccuggccagcccgaacuggaacaacuacgaccccacggaggagacccccgccccgcugggcacccccgacuucguggggaagauccacggcaugcucacccagacgacccaggggagcggcuccacccgcgcccaccgggcgaccgucuacgugggcagcgccgaguucacgcccaagcuggggaaggugcgcuucgagaccgacaccgaggacgaccuggucauccggcagaacaccaaguucacgcccgugggcgugauccaguccagcgagcaccaccgcgacgagccgcagcaguggcggcuccccaacuacuccggggccaacaccuucaacguccaccuggcccccgccguggcgcccaacuucccgggcgagcagcuccuguucuuccgcagcacccugcccgggugcggcggccaccccaacauggaccuggacugccuccugccccaggagugggugcagcacuucuaccaggaggccgccccggcccaguccgacgucgcgcugcuccgguucgugaaccccgacaccagccgcgugcuguucgagugcaagcugcacaaguccggguacgucacgguggcccacaccggccaguacgaccucgugcugcccagcaacggguacuuccgcuucgacuccugggucaaccaguucuacacccuggcccccaugggcaacgggaccggccggcgccgguga

SEQ ID NO: 12776 - RNA, 1614 nt, Artificial Sequence
  derived and/or modified sequence opt1 from VP1__Norovirus_and/or_Norovirus-like__KF712493
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggaggugcugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucccgacggaggggcugucccccagccaggugaccauguucccccaccugaucgucgacgugcggcagcucgagcccgugaugaucccgcugcccgacauccgcaacaacuucuaccacuacaaccaguccaacgaccccaccaucaagcugaucgcgaugcucuacacgccccugcgggccaacaacgucggcgacgacguguucacggugagcugccgcguccugacccggccgucccccgacuucgacuucaucuuccucgugccgcccaccguggagagcaagaccaaccccuucuccguccccauccugacgaucgaggagaugaccaacagccgcuuccccaucccccuggagaagcuguucaccggcccguccagcgcccucguggugcagccccagaacgggcggugcaccacggacggcguccugcucgggaccacccagcugucccccgugaacaucugcaccuuccgcggcgacgucacgcacaccaccaagacccacacguaccagaugaaccuggccgcccagaacuggaacagcuacgacccgaccgaggagauccccgcgccccucggcacccccgacuucguggggaagauccagggcgugcugacccagacgaccaaggggaacggcuccacccgggcccacaaggccaccgucuacaccgggggcguggaguucaccccgaagcugggccgcauccagcuguucaccgacaccgacaacgaccucgaggccaaccagaacacgaaguucacccccgugggggucauccaggacggcgacacccaccagaacgagccccagcagugggugcugcccagcuacagcgggcggaacaaccacaacgugcaccucgccccggcggucgcccccaccuuccccggcgagcagcugcuguucuuccgcuccacgaugcccgggugcagcggcuacccgaacaugaaccucgacugccugcugccccaggagugggugcaguacuucuaccaggaggccgcccccgcgcaguccgacguggcccuccugcgguucgucaaccccgacaccggccgcgugcuguucgagugcaagcuccacaagagcggguacgugaccgucgcccacaccggccaccacgaccuguucaucccgcccaacggguacuuccgguucgacuccugggugagccccuucuacacccuggcccccaugggcaacgggacgggccgccggcgcuga

SEQ ID NO: 12777 - RNA, 1614 nt, Artificial Sequence
  derived and/or modified sequence opt1 from VP1__Norovirus_and/or_Norovirus-like__FJ411169
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgccgacguguucaccgugagccgccggguccugacccgccccuccccggacuucgacuucaucuucagcgugccgcccaccguggagucccggacgaagcccuucaccguccccauccucaccguggaggagaugagcaacucccgcuuccccaucccccuggagaagcuguacaccggccccagcuccgccuucgugguccagccgcagaacgggcggugcacgaccgacggcgugcuccuggggaccacccagcugagcgccgucaacaucugcacguuccgcggcgacgugacccacaucgccggcucccacgacuacaccaugaaccucgcgagccagaacuggaacaacuacgaccccaccgaggagauccccgccccgcuggggacgcccgacuucgugggcaagauccaggggaugcugacccagaccacccgggaggacggcagcacgcgcgcccacaaggccaccgucuccaccgggagcgugcacuucacccccaagcucggcuccgugcaguacacgaccgacaccaacaacgacuuccagaccggccagaacacgaaguucacccccgucggggugauccaggacggcaacaaccaccagaacgagccgcagcagugggugcugcccaacuacagcgggcggaccggccacaacguccaccuggcccccgcgguggcccccaccuucccgggggagcagcuccuguucuuccgcuccacgaugcccggcugcagcggcuaccccaacaugaaccuggacugccuccugccccaggagugggugcagcacuucuaccaggaggccgccccggcgcaguccgacgucgcccugcuccgguucgugaaccccgacaccgggcgcgugcuguucgagugcaagcugcacaagagcggcuacgucaccguggcccacaccgggccccacgaccucgugaucccgcccaacggcuacuuccgguucgacuccugggucaaccaguucuacacccuggcccccauggggaacggcgccggccgccggcgcuga

SEQ ID NO: 12778 - RNA, 1614 nt, Artificial Sequence
  derived and/or modified sequence opt1 from VP1__Norovirus_and/or_Norovirus-like__AF427121
augaagauggccagcaacgacgccaaccccuccgacggcagcaccgcgaaccuggugccggaggucaacaacgaggugaugacccucgagcccguggucggggccgccaucgccgcccccguggcgggccagcagaacgugaucgaccccuggaucgggaacaacaucguccaggccccgggcggggaguucacggugagcccccgcaacgcccccggcgagauccugugguccgcgccccugggcccggaccucaaccccuaccugucccaccuggcccggauguacaacggguacgccggcggguucgaggugcaggucauccucgccggcaacgccuucaccgccgggaagaucaucuucgcggccgugccgcccaacuuccccaccgagggccugagccccucccaggugaccgucuucccccacaucaucguggacgugcgccagcuggagcccguccucaucccgcugcccgacgugcggaacaacuuccaccacuacaaccagagcaacgacuccacgaucaagcugaucgccaugcucuacacgccccugcgcgccaacaacgccggcgacgacguguucaccgucagcugccgggugcugacccgccccuccccggacuucgacuucaucuuccucgugccgcccaccaucgagagccggaccaagcccuucaccguccccauccugaccguggaggagauguccaacagccgcuuccccaucccccuggagaagcucuacacggggcccuccagcgcguucgugguccagccgcagaacggccggugcaccaccgacggggugcugcugggcaccacgcagcucuccgccgucaacaucugcaccuuccgcggcgacgugacccacaucgccgggagccacgacuacaccaugaaccuggccucccagaacuggaacaacuacgaccccacggaggagauccccgccccgcugggcacccccgacuucguggggaagauccagggcguccucacccagaccacgcgggaggacgggagcacccgcgcgcacaaggccaccgugagcaccggcuccgugcacuucacgcccaagcugggcagcguccaguacaccaccgacaccuccaacgacuuccagacggggcagaacaccaaguucacccccgugggcgugauccaggacgggaacaaccaccagaacgagccgcagcaguggguccugcccaacuacagcggccggaccgggcacaacgugcaccucgcccccgccguggcccccacguucccgggcgagcagcugcuguucuuccgcuccaccaugcccggcugcagcggguaccccaacaugaaccucgacugccugcugccccaggaguggguccagcacuucuaccaggaggcggccccggcccaguccgacguggcccuccugcgguucgugaacagcgacaccggccgcguccuguucgagugcaagcuccacaaguccggguacgugaccguggcgcacaccggcccccacgaccuggucaucccgcccaacggguacuuccgguucgacagcugggugaaccaguucuacacgcuggcccccaugggcaacggcgccgggcgccggcgcuga

SEQ ID NO: 12779 - RNA, 1614 nt, Artificial Sequence
  derived and/or modified sequence opt1 from VP1__Norovirus_and/or_Norovirus-like__KF429787
augaagauggccagcaacgacgccacccccuccgacggcagcuccgcgaaccuggugccggaggccaacaacgaggucauggcccucgagcccguggccggggccgcgaucgccgcccccguggccggccagcagaacgucaucgaccccuggauccgcaacaacuucgugcaggcgcccgggggcgaguucaccgugagcccccggaacgcccccggggagauccugugguccgccagccugggccccgaccucaacccguaccugucccaccugagccgcauguacaacggcuacgccggguccuucgagguccaggugauccucgccggcaacgcguucacggccgggaagaucaucuucgccgccgugccgcccaacuuccggaccgagggccugagccccucccagaucaccauguucccgcacaucaucaccgacguccgccagcuggagcccgugcucaucccccugcccgacauccggaacaacuucuaccacuacaaccagagcaacgacccgacgaucaagcugaucgccaugcucuacacgccccugcgcgcgaacaacgccggggacgacguguucaccgucuccugccgggugcugacccgccccagccccgacuucgacuucaucuuccucgugccgcccaccgucgagucccggaccaagcccuucagcgugcccgugcugaccgucgaggagaugaccaacucccgcuucccgaucccccuggagaagcuguucacgggccccagcuccgccuucguggugcagccccagaacggccggugcaccaccgacgggguccuccugggcaccacgcagcucagcccggugaacaucugcaccuuccgcggggacgugacccggaucggcaacagccgcgaguaccggaugaaccuggccucccugaacuggaacaacuacgaccccaccgaggagauccccgccccgcucggcacgcccgacuucgcggggaagauccagggcguccugacccagaccacccgccacgacgggagcacgcggggccacaaggccaccguguacaccggguccgccggcuucacccccaagcugggcagcguccaguucuccacggacaccgacaacgaccucgaggccaaccagaacacccgcuucacccccgugggggugauccaggacggcaacgcccaccagggggagccgcagcaguggguccugcccaacuacgcgggccgggacgggcacaacgugcaccuggcccccgccguggcccccacguucccgggcgagcagcuccuguucuuccgcagcaccaugcccggcugcuccggguaccccaacaugaaccuggacugccuccugccccaggaguggguccagcacuucuaccaggagagcgcgccggcccaguccgacguggcccugcuccgguucgugaaccccgacaccggccgcguccuguucgagugcaagcugcacaagagcggguacgugaccguggcccacacgggcccccacgaccucgucaucccgcccaacggguacuuccgcuucgacuccugggugaaccaguucuacacccuggcccccaugggcaacggcgcggggcggcgccgguga

SEQ ID NO: 12780 - RNA, 1614 nt, Artificial Sequence
  derived and/or modified sequence opt1 from VP1__Norovirus_and/or_Norovirus-like__AB933728
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccaucccgcccaacuucccgacggaggggcugagccccucccaggugaccauguucccccacaucguggucgacgugcggcagcuggagcccgugcucaucccgcugcccgacguccgcaacaacuucuaccacuacaaccagaccaaggagagcaccaucaagcugguggccaugcucuacacgccccugcgggcgaacaacgccggcgacgacguguucaccgucuccugccgcgugcugacccggcccagcccggacuucgacuucaucuuccucgugccgcccuccgucgagagccgcaccaagcccuucacggugcccauccugaccguggaggagaugaccaacucccgguuccccaucccccuggagcgccucuucaccggccccagcuccgccuucgucgugcagccgcagaacgggcggugcacgaccgacggcguccugcuggggaccacccagcucagccccgugaacaucugcacguuccgcggcgacgugacccgggucuccaccacccacguguacgagaugaaccuggccagccagaacuggaacaacuacgaccccacggaggaggugccggcgccccugggcacccccgacuucgucgggaagauccagggcgugcucacccagaccacgcgcaccgacggguccacccgggcccacaaggccaccgugagcacgggcgccgccgacuucacccccaagcuggggagcauccgcuucgagaccaccacgaaccgggaccuggagacccaccagaacaccaaguucaccccggucggcgugauccaggacggcgacaaccaccagaacgagccccagcaguggcgccuccccggguacgccggccgggacgcgcacaacgugcaccuggcccccgccgucgccccgacguuccccggggagcagcuccucuucuuccgcuccaccaugcccggcugcagcggguaccccaacaugaaccuggacugccugcucccgcaggagugggugcagcacuucuaccaggaggcggcccccgcccaguccgacguggcccugcugcgguucgucaaccccgacaccggccgcgugcuguucgagugcaagcugcacaagagcggcuaccugaccguggcccacaccgggcccuacgaccucgucaucccgcccaacggcuacuuccgcuucgacuccugggugaaccaguucuacacgcuggcgcccauggggaacggcaccgggcggcgccgguga

SEQ ID NO: 12781 - RNA, 1614 nt, Artificial Sequence
  derived and/or modified sequence opt1 from VP1__Norovirus_and/or_Norovirus-like__KX514346
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccgugaaccuggagcgccucuucaccgggcccuccagcgccaacgucgugcagccgcagaacggccggugcacgaucgacggggagcugcugggcaccacccagcucuccagcgucaacaucugcaccuuccgcggcgacgugacgcagaucggguccaccaagcacuggaccaugaaccuggccagccccaacuggaacaacuacgaccccaccgaggagacgccggcgccccugggcacccccgacuucguggggaagauccacggcaugcucacccagaccacgcaggagaacgggagcacccgggcccaccgcgccaccgucuacgugggcggcuccaacuucacccccaagcuggggaaggugccguucgagacggacaccggcgacgaccuggccauccggcagaacaccaaguucacccccgucggggugauccagagcuccggccaccaccgcgacgagccccagcaguggcggcuccccaacuacagcggggccaacacguucaacgugcaccuggccccggccgucgcgcccaacuuccccggcgagcagcuccuguucuuccgcuccacccugcccggcugcgggggccacccgaacauggaccuggacugccuccugccccaggagugggugcagcacuucuaccaggaggccgcccccgcccagagcgacguggcgcugcuccgguucgucaaccccgacaccucccgcgugcuguucgagugcaagcugcacaagagcggguacgugaccgucgcccacacgggccaguacgaccucgugcugccguccaacggguacuuccgguucgacagcugggugaaccaguucuacacccuggcccccaugggcaacggcaccgggcgccgccgguga

SEQ ID NO: 12782 - RNA, 1614 nt, Artificial Sequence
  derived and/or modified sequence opt1 from VP1__Norovirus_and/or_Norovirus-like__KX514249
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgaccucaucuuccuggugccgcccaccguggagucccgcacgaagcccuucagcguccccauccugaccgugggcgagaugaccaacucccgguuccccaucaaccucgaggggcuguucaccggccccagcuccgccaacgugguccagccgcagaacgggcgcugcacgaucgacggcgagcugcucggcaccacccagcugagcuccgugaacaucugcaccuuccgcggggacgucacgcacaucggcagcacccaccacuggaccaugaaccuggccagccccaacuggaacaacuacgaccccaccgaggagacgccggcgccccucgggacccccgacuucgugggcaagauccacgggaugcugacccagaccacgcagggcuccggcagcacccgggcccaccgggccaccguguacgucgggggcgccgaguucacccccaagcuggggaaggugcaguucaagacggagaccaaccacgaccucuccauccgccagaacaccaaguucaccccggugggcgucauccaggagagcgaccaccaccgggacgagccccagcaguggcgccugcccaacuacuccggggccaacacguucaacgugcaccuggcccccgccguggcgccgaacuuccccggcgagcagcuccuguucuuccggagcacccugcccggcugcgggggccaccccaacauggaccucgacugccugcugccgcaggaguggguccagcacuucuaccaggaggccgcccccgcccaguccgacguggcgcuccugcgcuucgugaaccccgacaccagccggguccuguucgagugcaagcuccacaaguccggguacgugaccguggcccacacgggccaguacgaccugguccugcccagcaacggguacuuccgcuucgacuccugggugaaccaguucuacacccucgccccgaugggcaacggcaccgggcggcgccgcuga

SEQ ID NO: 12783 - RNA, 1614 nt, Artificial Sequence
  derived and/or modified sequence opt1 from VP1__Norovirus_and/or_Norovirus-like__KF429760
augaagauggccagcaacgacgccacccccuccgacggcagcuccgcgaaccuggugccggaggucaacaacgaggugauggcccucgagcccguggccggggccgccaucgcggcccccgucgccggccagcagaacgugaucgaccccuggauccgcaacaacuucgugcaggcccccgggggcgaguucaccgucagcccccggaacgcgcccggggagauccugugguccgccagccugggccccgaccucaacccguaccugucccaccugagccgcauguacaacggcuacgccggguccuucgagguccaggugauccucgccggcaacgccuucacggcggggaagaucaucuucgccgccgugccgcccaacuuccggaccgagggccugagccccucccagaucaccauguucccgcacaucaucaccgacgugcgccagcuggagcccgugcucaucccccugcccgacauccggaacaacuucuaccacuacaaccagagcaacgacccgacgaucaagcugaucgccaugcucuacacgccccugcgcgccaacaacgcgggggacgacgucuucaccguguccugccgggugcugacccgccccagccccgacuucgacuucaucuuccucgucccgcccaccguggagucccggaccaagcccuucagcgugcccguccugaccguggaggagaugaccaacucccgcuucccgaucccccuggagaagcuguucacgggccccagcuccgccuucgugguccagccccagaacggccggugcaccaccgacggggugcuccugggcaccacgcagcucagcccggugaacaucugcaccuuccgcggggacgucacccggaucggcaacagccgcgaguaccggaugaaccuggccucccugaacuggaacaacuacgaccccaccgaggagauccccgccccgcucggcacgcccgacuucgccgggaagauccagggcgugcugacccagaccacccgccacgacgggagcacgcggggccacaaggcgaccgucuacaccggguccgccggcuucacccccaagcugggcagcgugcaguucuccacggacaccgacaacgaccucgaggccaaccagaacacccgcuucacccccgugggggucauccaggacggcaacgcccaccagggggagccgcagcagugggugcugcccaacuacgccggccgggacgggcacaacgugcaccuggcgcccgccgucgcccccacguucccgggcgagcagcuccuguucuuccgcagcaccaugcccggcugcuccggguaccccaacaugaaccuggacugccuccugccccaggagugggugcagcacuucuaccaggagagcgccccggcgcaguccgacguggcccugcuccgguucgucaaccccgacaccggccgcgugcuguucgagugcaagcugcacaagagcggguacgugaccgucgcccacacgggcccccacgaccucgugaucccgcccaacggguacuuccgcuucgacuccugggugaaccaguucuacacccuggcccccaugggcaacggcgccgggcggcgccgguga

SEQ ID NO: 12784 - RNA, 1614 nt, Artificial Sequence
  derived and/or modified sequence opt1 from VP1__Norovirus_and/or_Norovirus-like__AB303929
augaagauggccagcaacgacgccaaccccuccgacggcagcgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugucccaccugagccgcauguacaacggcuacgccgggggcuucgagguccaggugauccucgccgggaacgccuucaccgccggcaaggugaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaggcccacgacuccacccugaagcucaucgccaugcuguacacgccccugcgggcgaacaacgccggcgacgacguguucaccgugagcugccgcguccucacccggcccuccccggacuucgacuucaucuuccuggugccgcccaccguggagagccgcaccaagcccuucacgguccccgugcugaccguggaggagaugaccaacucccgguuccccaucccccucgagaagcuguacaccggccccagcuccgccaucgucgugcagccgcagaacgggcgcugcacgaccgacggcguccugcucgggaccacccagcugagcgccgugaacaucugcacguuccggggcgacgugacccacaucgccggcucccgcaacuacaccaugaaccuggcgagccagaacuggaacaacuacgaccccaccgaggagauccccgccccgcucgggacgcccgacuucgucggcaagauccaggggcugcugacccagaccacccgggccgacggcuccacgcgcgcccacaaggccaccgugagcaccgggagcgugcacuucacccccaagcucggcuccguccaguucagcacggacaccgacaacgacuuccagcccggccagaacaccaaguucaccccggugggggugauccaggacggcgaccggcaccagaacgagccccagcaguggguccugcccgacuucuccgggcgcacgggccacaacgugcaccuggcgcccgccguggccccgaccuuccccggggagcagcuccuguucuuccggagcaccaugcccggccgcuccggcuaccccaacaugaaccuggacugccuccugccgcaggaguggguccugcacuucuaccaggagagcgcccccgcgcaguccgacguggcccuccugcgguucgugaaccccgacaccaaccgcguccuguucgagugcaagcuccacaagagcggguacaucacgguggcccacaccggccaccacgaccugauccugcccccgaacggguacuuccgguucgacuccugggugaaccaguucuacacccucgcccccaugggcaacggggccggccgccgccgguga

SEQ ID NO: 12785 - RNA, 1614 nt, Artificial Sequence
  derived and/or modified sequence opt1 from VP1__Norovirus_and/or_Norovirus-like__KX514363
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccaucaaccuggagcgccucuucacggggcccagcuccgcgaacgugguccagccgcagaacggccggugcaccaucgacggggagcugcugggcaccacccagcucagcuccgugaacaucugcacguuccgcggcgacgucacccagaucgggagcacccagcacuggaccaugaaccuggccagccccaacuggaacaacuacgaccccacggaggagaccccggcgccccugggcacccccgacuucguggggaagauccacggcaugcucacccagacgacccaggagaacggguccacccgggcccaccgcgccaccguguacgucggcggcgccaacuucacgcccaagcuggggaaggugcgguucgagaccgacaccggcgacgaccuggccauccgccagaacaccaaguucacgccggugggggucauccagagcuccgaccaccaccgggacgagccccagcaguggcgccuccccaacuacagcggcgccaacaccuucaacgugcaccuggcccccgccguggcgccgaacuuccccggggagcagcuccuguucuuccgguccacccugcccggcugcggcgggcaccccaacauggaccuggacugccuccugccgcaggaguggguccagcacuucuaccaggaggccgcccccgcccagagcgacguggcgcugcuccgcuucgugaaccccgacaccucccggguccuguucgagugcaagcugcacaagagcggcuacgugacgguggcccacaccgggcaguacgaccucguccugcccuccaacggcuacuuccgcuucgacagcugggugaaccaguucuacacccuggccccgauggggaacggcaccggccgccggcgcuga

SEQ ID NO: 12786 - RNA, 1614 nt, Artificial Sequence
  derived and/or modified sequence opt1 from VP1__Norovirus_and/or_Norovirus-like__KX514357
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcacaucgggagcacccaccacuggaccaugaaccuggccagccccaacuggaacaacuacgaccccaccgaggagacgccggcgccccugggcacccccgacuucguggggaagauccacggcaugcucacccagaccacgcagggguccggcagcacccgggcccaccgcgccaccguguacgucggcuccgccgacuucacccccaagcuggggaaggugcaguucgagacggagaccgaccacgaccuggccauccggcagaacaccaaguucaccccggugggcgucauccaggagagcgacaaccaccgcgacgagccccagcaguggcggcuccccaacuacuccggggccaacacguucaacgugcaccuggcccccgcgguggccccgaacuuccccggcgagcagcuccuguucuuccgcagcaccauccccgggugcggcggccaccccaacaugaaccuggacugccugcucccgcaggaguggguccagcacuucuaccaggaggccgcccccgcgcaguccgacguggcccugcugcgguucgugaaccccgacaccagccgcguccucuucgagugcaagcugcacaaguccggguacgugaccguggcccacacgggccagcacgaccuggucaucccgcccaacggguacuuccgguucgacagcugggugaaccaguucuacacccucgcccccaugggcaacgggaccggccgcaagcgcuga

SEQ ID NO: 12787 - RNA, 1614 nt, Artificial Sequence
  derived and/or modified sequence opt1 from VP1__Norovirus_and/or_Norovirus-like__KX514240
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccacccccgcgacucccccaucuacacgaugaaccuggccagcccgaacuggaacaacuacgaccccaccgaggagauccccgcgccccugggcaccccggacuucgucgggaagauccacggcaugcucacccagacgacccaggggagcggcuccacccgggcccaccgcgccaccguguacguggggagcgccgaguucacgcccaagcugggcaagguccaguuccagaccgagaccgaggacgaccuggugauccggcagaacaccaaguucacgcccgugggcgucauccaggaguccgaccaccaccgcgacgagccccagcagugggugcucccgagcuacuccgggcgggacacccccaacgugcaccuggcccccgccgucgcgcccaccuucccgggcgagcagcuccucuucuuccgcagcaccauccccgggugcggcgggcaccccaacaugaaccuggacugccugcucccccaggagugggugcagcacuucuaccaggaggccgccccggcccaguccgacguggcgcugcugcgguucgucaaccccgacacgagccgcguccucuucgagugcaagcugcacaaguccggcuacgugaccguggcccacaccggccagcacgaccuggugaucccgcccaacggguacuuccgguucgacagcugggugaaccaguucuacacccucgcccccaugggcaacgggacgggccgcaagcgcuga

SEQ ID NO: 12788 - RNA, 1614 nt, Artificial Sequence
  derived and/or modified sequence opt1 from VP1__Norovirus_and/or_Norovirus-like__AF414417
augaagauggccagcaacgacgccaaccccuccgacggcagcgcggccaaccuggugccggaggucaacaacgaggugauggcccucgagcccguggucgacgccgccaucgcggcccccguggccgggcagcagaacgugaucgaccccuggauccgcaacaacuucguccaggccccgggcggggaguucaccgugagcccccggaacgcgcccggcgagauccugugguccgcgccccuggggccggaccccaaccccuaccucucccaccugagccgcauguacaacggcuacgccggcggguucgaggugcaggucauccuggccggcaacgccuucaccgccgggaaggugaucuucgccgccgugcccccgaacuuccccacggagggccucucccccagccaggucaccauguucccccacaucaucguggacgugcggcagcuggagccgaugcugaucccccuccccgacguccgcaacaacuucuaccacuacaaccaggccaacgacuccacccugaagcugaucgccacccucuacacgccccugcgggcgaacaacgccggggacgacguguucaccgugagcugccgcguccugacccggccgucccccgacuucgacuucaucuuccucgugccgcccaccguggagagccgcacgaagcccuucaccguccccgugcugaccguggaggagauguccaacagccgguuccccaucccccuggagaagcucuacaccggcccguccagcgccuucgucgugcagccccagaacggccgcugcacgaccgacgggguccugcugggcaccacccagcucuccgccgugaacaucugcaacuuccgcggggacguggcccacaucgcgggcagccacgacuacacgaugaaccuggccucccagaacuggagcaacuacgaccccaccgaggagaucccggcgccccugggcacccccgacuucgucgggaagauccagggccuccugacccagacgacccgggccgacgggcugacccgggcccacaaggccaccgugagcacgggcuccgugcacuucacccccaagcucgggagcguccaguucaccaccgacacgaacaacgacuuccaggccggccagaacaccaaguucaccccggugggcgugauccaggacggggaccaccaccagaacgagccccagcaguggcugcugcccaacuacuccggccgcaccgggcacaacguccaccucgcccccgccguggcgccgacguuccccggcgagcagcugcuguucuuccggagcaccaugcccgggugcuccggcuaccccaacaugaaccucgacugccugcugccgcaggagugggugcuccacuucuaccaggaggccgcccccgcccagagcgacgucgcccugcugcgcuucgugaaccccgacaccggccggguccucuucgagugcaagcugcacaaguccggguacaucaccguggcgcacacgggccccuacgaccuggugcucccgcccaacggguacuuccgcuucgacagcugggugaaccaguucuacacccuggcccccaugggcaacgggaccggccggcgccgguga

SEQ ID NO: 12789 - RNA, 1614 nt, Artificial Sequence
  derived and/or modified sequence opt1 from VP1__Norovirus_and/or_Norovirus-like__KX514303
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccgugaaccuggagcgccucuucacggggcccagcuccgcgaacgucgugcagccgcagaacggccggugcaccaucgacggggagcugcugggcaccacccagcucagcuccgucaacaucugcacguuccgcggcgacgugacccagaucgggagcacccggcacuggaccaugaaccuggccagccccaacuggaacaacuacgaccccacggaggagaccccggcgccccugggcacccccgacuucguggggaagauccacggcaugcucacccagacgacccagggguccggcagcacccgcgcccaccgggccaccgucuacgugggcuccgccgaguucacgcccaagcuggggaaggugcgcuucgagaccgacaccgaggacgaccuggucauccggcagaacaccaaguucacgccggugggcgugauccagagcuccgaccaccaccgcgacgagccccagcaguggcggcuccccaacuacagcggggccaacaccuucaacguccaccuggcccccgccguggccccgaacuuccccggcgagcagcuccuguucuuccgcuccacccugcccgggugcggcggccaccccaacauggaccuggacugccuccugccgcaggagugggugcagcacuucuaccaggaggcggcccccgcccagagcgacgucgcccugcuccgguucgugaaccccgacaccucccgcgugcuguucgagugcaagcugcacaagagcggguacgucacgguggcgcacaccggccaguacgaccucgugcugcccuccaacggguacuuccgcuucgacagcugggucaaccaguucuacacccuggccccgaugggcaacgggaccggccggcgccgguga

SEQ ID NO: 12790 - RNA, 1614 nt, Artificial Sequence
  derived and/or modified sequence opt1 from VP1__Norovirus_and/or_Norovirus-like__KX514273
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaacgcgggcgacgacguguucaccguguccugccgcguccugacccggcccagcccggacuucgacuucaucuuccucgugccgcccaccguggagucccgcagcaagcccuucuccguccccgugcugaccguggaggagaugaccaacagccgguuccccgccacccuggacaagcuguucacgggccccuccagcaccuucgucgugcagccccagaacgggcgcugcaugaucgacggcguccugcuggggaccacccagcucuccccggugaacaucugcacguuccggggcgacgugacccacccccgcgacagccccaucuacaccaugaaccuggccagcccgaacuggaacaacuacgaccccaccgaggagauccccgcgccccugggcacgccggacuucaccgggaagauccagggcaugcucacccagaccacgaagggggagggcuccacccgggggcaccgcgccaccgucuacgugggcagcgccgaguucacccccaagcugggcaaggugcgguucgagacggacaccgaggacgaccuggucauccgccagaacaccaaguucacccccgugggggugauccaguccagcgaccaccaccgggacgagccccagcaguggcgccucccgaacuacuccggcgccaacacguucaacguccaccuggcccccgccguggcccccaacuuccccggggagcagcuccucuucuuccggagcacccugccgggcugcgggggccaccccaacauggaccuggacugccuccugccccaggagugggugcagcacuucuaccaggaggcggcccccgcccaguccgacgucgcccugcuccgcuucgugaacccggacaccagccgggugcuguucgagugcaagcugcacaaguccggcuacgucaccguggcgcacacggggcaguacgaccucgugcugcccagcaacggcuacuuccgcuucgacuccugggucaaccaguucuacacccuggcccccauggggaacggcaccgggcgccggcgcuga

SEQ ID NO: 12791 - RNA, 1614 nt, Artificial Sequence
  derived and/or modified sequence opt1 from VP1__Norovirus_and/or_Norovirus-like__KX514323
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccccagaacgggcgcugcaugaucgacggcguccugcuggggacgacccagcucagcccggugaacaucugcaccuuccggggcgacgugacccaccccggcaacuccaagaucuacacgaugaaccuggccagccccaacuggaacaacuacgacccgaccgaggagauccccgcgccccuggggacccccgacuucgucggcaagauccacgggaugcucacccagacgacccaggagaacggcagcacccgcgcccaccgggccaccguguacgucgggggcgccaacuucacgccgaagcugggcaaggugcaguucgagaccgacaccggggacgaccuggccauccgccagaacaccaaguucacgcccgugggcgugauccaguccagcgaccaccaccgggacgagccccagcaguggcgccuccccaacuacuccggggccaacaccuucaacguccaccuggcgccggccguggcccccaacuuccccggcgagcagcuccucuucuuccggagcaccauccccgggugcggcggccacccgaacaugaaccuggacugccugcucccccaggagugggugcagcacuucuaccaggaggccgcgcccgcccaguccgacgucgcccugcugcgcuucgugaaccccgacaccagccggguccucuucgagugcaagcugcacaaguccggguacgugacgguggcccacaccggccagcacgaccuggugaucccgcccaacggguacuuccgcuucgacagcugggucaaccaguucuacacccucgcccccaugggcaacgggaccggccggaagcgcuga

SEQ ID NO: 12792 - RNA, 1614 nt, Artificial Sequence
  derived and/or modified sequence opt1 from VP1__Norovirus_and/or_Norovirus-like__KX514364
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccaucaaccuggagcgccucuucacggggcccagcuccgcgaacgugguccagccgcagaacggccggugcaccaucgacggggagcugcugggcaccacccagcucagcuccgugaacaucugcacguuccgcggcgacgucacccagaucgggagcaccaagcacuggaccaugaaccuggccagccccaacuggaacaacuacgaccccacggaggagaccccggcgccccugggcacccccgacuucguggggaagauccacggcaugcucacccagacgacccaggagaacggguccacccgggcccaccgcgccaccguguacgucggcggcgccaacuucacgcccaagcuggggaaggugcaguucgagaccgacaccggcgacgaccuggccauccggcagaacaccaaguucacgccggugggggucauccagagcuccgaccaccaccgcgacgagccccagcaguggcggcuccccaacuacagcggcgccaacaccuucaacgugcaccuggcccccgccguggcgccgaacuuccccggggagcagcuccuguucuuccgcuccacccugcccggcugcggcgggcaccccaacauggaccuggacugccuccugccgcaggaguggguccagcacuucuaccaggaggccgcccccgcccagagcgacguggcgccccugcgguucgugaaccccgacaccucccgcguccucuucgagugcaagcugcacaagagcggcuacgugacgguggcccacaccgggcaguacgaccugguccucccguccaacggcuacuuccgguucgacagcugggugaaccaguucuacacccuggcccccauggggaacggcaccggccgccgccgguga

SEQ ID NO: 12793 - RNA, 1614 nt, Artificial Sequence
  derived and/or modified sequence opt1 from VP1__Norovirus_and/or_Norovirus-like__KX514338
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugaccguggaggagaugacgaacucccgguuccccgccacccuggacaagcuguucaccggccccagcuccaacuucgucgugcagccccagaacgggcgcugcaugaucgacggcguccugcuggggaccacgcagcucagcccggugaacaucugcaccuuccggggcgacgugacccagaucggcuccaccaagcacuggacgaugaaccuggccagccccaacuggaacaacuacgaccccaccgaggagaccccggcgccccuggggacccccgacuucgucggcaagauccacgggaugcucacgcagaccacccaggagaacggcagcacccgcgcccaccgggccacgguguacgucgggggcgccaacuucacccccaagcugggcaaggugcaguucgagaccgacaccguggacgaccuggagauccgccagaacacgaaguucaccccggugggggucauccaguccagcgaccaccaccgggacgagccccagcaguggcgccuccccaacuacuccggcgccaacaccuucaacgugcaccuggcccccgcgguggccccgaacuuccccggggagcagcuccucuucuuccggagcacccugcccggcugcgggggccaccccaacauggaccuggacugccuccugccgcaggaguggguccagcacuucuaccaggaggccgcccccgcgcaguccgacguggcccugcuccgcuucgugaaccccgacacgagccggguccuguucgagugcaagcugcacaaguccggcuacgugaccguggcccacaccgggcaguacgaccucguccugcccagcaacggcuacuuccgcuucgacuccugggugaaccaguucuacacccuggccccgauggggaacggcacggggcggcgccgcuga

SEQ ID NO: 12794 - RNA, 1614 nt, Artificial Sequence
  derived and/or modified sequence opt1 from VP1__Norovirus_and/or_Norovirus-like__KX514316
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcagcaagcccuucuccguccccgugcugaccguggaggagaugaccaacagccgguuccccgcgacccuggacaagcuguucacgggccccuccagcaccuucgucgugcagccgcagaacgggcgcugcaugaucgacggcguccugcuggggaccacccagcucucccccgugaacaucugcacguuccggggcgacgugacccacccccgcgacagcaagaucuacaccaugaaccuggccagcccgaacuggaacaacuacgaccccaccgaggagauccccgcgccccugggcacgccggacuucgucgggaagauccagggcaugcucacccagaccaccaagggggagggcuccacgcgggggcaccgcgccaccguguacgugggcagcgccaacuacgcccccaagcugggccggguccaguucgagaccgacaccacggacgaccuggacgcccaccagaacaccaaguucacccccgugggggugauccaguccagcgaccaccaccgcgacgagccccagcaguggcggcucccgaacuacuccggcgccaacaccuucaacguccaccuggcccccgccguggcgcccaacuuccccggggagcagcuccucuucuuccgcagcacgcugccgggcugcgggggccaccccaacauggaccuggacugccuccugccccaggagugggugcagcacuucuaccaggaggccgcccccgcccaguccgacgucgcgcugcuccgguucgugaacccggacaccagccgcgugcuguucgagugcaagcugcacaaguccggcuacgucaccguggcccacaccgggcaguacgaccucgugcugcccagcaacggcuacuuccgguucgacuccugggucaaccaguucuacacgcuggcccccauggggaacggcaccgggcgcaagcgcuga

SEQ ID NO: 12795 - RNA, 1614 nt, Artificial Sequence
  derived and/or modified sequence opt1 from VP1__Norovirus_and/or_Norovirus-like__KX514356
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacugcuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcacgaagcccuucagcguccccauccugaccgugggcgagaugaccaacucccgguuccccaucaaccuggagcgccucuucaccgggcccagcuccgccaacgugguccagccgcagaacggccggugcacgaucgacggggagcugcugggcaccacccagcucagcuccgugaacaucugcaccuuccgcggcgacgucacgcacaucgggagcacccaccacuggaucaugaaccuggccagccccaacuggaacaacuacgaccccaccgaggagaccccggcgccccugggcacgcccgacuucguggggaagauccacggcaugcucacccagaccacccagggguccggcagcacgcgggcccaccgcgccaccguguacgucggcuccgccgacuucacccccaagcuggggaaggugcaguucgagaccgagacggaccacgaccuggccauccggcagaacaccaaguucaccccggugggcgucauccaggagagcgaccaccaccgcgacgagccccagcaguggcggcuccccaacuacuccggggccaacaccuucaacgugcaccuggcccccgcgguggccccgacguuccccggcgagcagcuccuguucuuccgcagcaccauccccgggugcggcggccaccccaacaugaaccuggacugccugcucccgcaggaguggguccagcacuucuaccaggaggccgcccccgcgcaguccgacguggcccugcugcgguucgugaaccccgacaccagccgcguccucuucgagugcaagcugcacaaguccggguacgugaccguggcccacacgggccagcacgaccuggucaucccgcccaacggguacuuccgguucgacagcugggugaaccaguucuacacccucgcccccaugggcaacgggaccggccgcaagcgcuga

SEQ ID NO: 12796 - RNA, 1614 nt, Artificial Sequence
  derived and/or modified sequence opt1 from VP1__Norovirus_and/or_Norovirus-like__KX514349
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcuccaagcccuucagcguccccgugcugaccguggaggagaugacgaacucccgguuccccgccacccuggacaagcuguucaccggccccagcuccaccuucgucgugcagccgcagaacgggcgcugcaugaucgacggcguccugcuggggacgacccagcucagccccgugaacaucugcaccuuccggggcgacgugacccaguccggcaacacgaagaucuacaccaugaaccuggccagccccaacuggaacaacuacgacccgaccgaggagauccccgcgccccuggggacccccgacuucgucggcaagauccaggggaugcucacgcagaccaccaagggcgaggggagcacccgcggccaccgggccacgguguacgugggcggggccgaguucaccccgaagcugggcaagguccgcuucgagaccgacaccgaggacgaccuggugauccggcagaacacgaaguucacccccgugggggucauccagaccuccgagaaccaccgcgacgagccccagcaguggcggcuccccaacuacagcggccgcgacaccccgaacgugcaccuggcccccgccguggcccccacguuccccggggagcagcuccucuucuuccgguccaccaucccgggcugcggcgggcaccccaacaugaaccuggacugccugcucccccaggaguggguccagcacuucuaccaggaggccgcgcccgcccagagcgacguggcccugcugcgcuucgugaacccggacaccucccggguccucuucgagugcaagcugcacaagagcggcuacgugaccguggcccacacggggcagcacgaccuggucaucccgcccaacggcuacuuccgcuucgacuccugggugaaccaguucuacacccucgcgcccauggggaacggcaccggccgcaagcgguga

SEQ ID NO: 12797 - RNA, 1614 nt, Artificial Sequence
  derived and/or modified sequence opt1 from VP1__Norovirus_and/or_Norovirus-like__KX514217
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcuccaagcccuucagcguccccgugcugacgguggaggagaugaccaacucccgguuccccgccacccuggacaagcuguucaccggccccagcuccacguucgucgugcagccccagaacgggcgcugcaugaucgacggcguccugcuggggaccacccagcucagcccggugaacaucugcaccuuccggggcgacgugacgcacccccgcgacucccccaucuacaccaugaaccuggccagcccgaacuggaacaacuacgaccccaccgaggagauccccgcgccccugggcaccccggacuucgucgggaagauccagggcaugcucacgcagaccacccaggggagcggcuccacccgggcccaccgcgccacgguguacguggggagcgccgaguucacccccaagcugggcaagguccaguuccagaccgagaccgaccacgaccuggugauccggcagaacacgaaguucacccccgugggcgucauccaggaguccgaccaccaccgcgacgagccccagcaguggcggcucccgaacuacagcggggccaacaccuucaacgugcaccuggcccccgcgguggcccccaacuuccccggcgagcagcuccucuucuuccgcuccacccugccggggugcggcgggcaccccaacauggaccuggacugccuccugccccaggaguggguccagcacuucuaccaggaggccgcccccgcgcagagcgacguggcccugcuccgguucgugaacccggacacgucccgcguccuguucgagugcaagcugcacaagagcggcuacgugaccguggcccacaccggccaguacgaccucguccugcccuccaacggguacuuccgguucgacagcugggugaaccaguucuacacccuggcccccaugggcaacgggacgggccgccgccgguga

SEQ ID NO: 12798 - RNA, 1614 nt, Artificial Sequence
  derived and/or modified sequence opt1 from VP1__Norovirus_and/or_Norovirus-like__KX514324
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcagcaagcccuucuccguccccgugcugaccguggaggagaugaccaacagccgguuccccgcgacccuggacaagcuguucacgggccccuccagcaccuucgucgugcagccgcagaacgggcgcugcaugaucgacggcguccugcuggggaccacccagcucucccccgugaacaucugcacguuccggggcgacgugacccacagcggcaacagcaagaucuacaccaugaaccuggccucccccaacuggaacaacuacgacccgaccgaggagauccccgcgccccuggggacgcccgacuucgucggcaagauccaggggaugcucacccagaccaccaagggcgaggggagcacgcgcggccaccgggccaccguguacgugggcggggccaacuucaccccgaagcugggcaagguccaguucgagaccgacacgguggacgaccuggagauccgccagaacaccaaguucacccccgugggggucauccaguccagcgaccaccaccgggacgagccccagcaguggcgccuccccaacuacuccggcgccaacaccuucaacgugcaccuggccccggccguggcccccaacuuccccggggagcagcuccucuucuuccggagcacgcugcccggcugcggcgggcacccgaacauggaccuggacugccuccugccccaggaguggguccagcacuucuaccaggaggccgcgcccgcccaguccgacguggcccugcuccgcuucgugaaccccgacaccagccggguccuguucgagugcaagcugcacaaguccggcuacgugaccguggcccacaccgggcagcacgaccucgucaucccgcccaacggcuacuuccgcuucgacagcugggugaaccaguucuacacgcuggcgcccauggggaacggcaccggccggaagcgcuga

SEQ ID NO: 12799 - RNA, 1614 nt, Artificial Sequence
  derived and/or modified sequence opt1 from VP1__Norovirus_and/or_Norovirus-like__KX514306
augaagauggccagcuccgacgccaaccccagcgacggcuccaccgcgaaccuggugccggaggucaacaacgaggugauggcccucgagcccguggucgggguggccaucgccgcccccguggcgggccagcagaacgucaucgaccccuggauccgcaacaacuucgugcaggcccccgggggcgaguucaccgugagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggccggcaagaucaucuucgcggccgugccgcccaccuucccgaccgaggggcugucccccagccaggucaccauguucccccacaucaucguggacgugcggcagcuggagcccguccucaucccgcugcccgacgugcgcaacaacuucuaccacuacaaccaguccaacgacagcacgaucaagcugaucgccaugcucuacacgccccugcgggccaacaaccccggcgacgacguguucaucgucuccugccgcgugcugacccggccgagccccgacuucgacuucaucuuccucgugccgcccaccgucgagucccgcaccaagcccuucagcgugcccauccugaccgugggcgagaugaccaacucccgguuccccaucaaccuggagcgccucuucaccgggcccagcuccgccaacgucgugcagccgcagaacggccggugcacgaucgacggggagcugcugggcaccacccagcucagcuccgucaacaucugcaccuuccgcggcgacgugacgcagaucgggagcacccagcacuggaccaugaaccuggcgagccccaacuggaacaacuacgaccccaccgaggagacgccggcgccccugggcacccccgacuucguggggaagauccagggcaugcucacccagaccacgcaggagaacggguccacccgggcccaccgcgccaccgucuacgugggcggcgccaacuacgcccccaagcuggggaaggugcaguucgagaccgacacgggcgacgaccuggccauccggcagaacaccaaguucaccccggucggggugauccagagcuccgaccaccaccgcgacgagccccagcaguggcggcuccccaacuacagcggcgccaacaccuucaacgugcaccuggcccccgccgucgcgccgaacuuccccggggagcagcuccuguucuuccgcuccacgcugcccggcugcggcgggcaccccaacauggaccuggacugccuccugccgcaggagugggugcagcacuucuaccaggaggccgcccccgcccagagcgacgugacccugcuccgguucgucaaccccgacaccucccgcgugcuguucgagugcaagcugcacaagagcggcuacgugaccgucgcgcacacggggcaguacgaccucgugcugcccuccaacggcuacuuccgguucgacagcugggugaaccaguucuacacccuggccccgauggggaacggcaccggccgccgccgguga

SEQ ID NO: 12800 - RNA, 1614 nt, Artificial Sequence
  derived and/or modified sequence opt1 from VP1__Norovirus_and/or_Norovirus-like__AB186063
augaagauggccagcaacgacgugaaccccuccgacggcagcgccgcgaaccuggucccggaggugaacaacgaggugauggcccucgagcccgucgugggggccgccaucgccgcgcccguggccggccagcagaacaucaucgaccccuggauccgcaacaacuucguccaggcccccgggggcgaguucaccgugagcccccggaacgcccccggggagauccugugguccgcgccccugggcccggaccucaaccccuaccugucccaccugagccgcauguacaacggcuacgccgggggcuucgaggugcaggucauccucgccgggaacgccuucaccgccggcaaggugaucuucgcggccgugccgcccaacuucccgacggaggggcugucccccagccaggucaccauguucccccacaucaucguggacgugcggcagcuggagcccguccucaucccgcugcccgacgugcgcaacaacuucuaccacuacaaccaggcccacgacuccacccugaagcucaucgccaugcuguacacgccccugcgggccaacaacgcgggcgacgacguguucaccgucagcugccgcgugcucacccggcccuccccggacuucgacuucaucuuccuggugccgcccaccgucgagagccgcaccaagcccuucacggugcccgugcugaccgucgaggagaugaccaacucccgguuccccaucccccucgagaagcuguacaccggccccagcuccgccuucgugguccagccgcagaacgggcgcugcacgaccgacggcgugcugcucgggaccacccagcugagcgccgugaacaucugcacguuccggggcgacgucacccacaucgccggcucccgcaacuacaccaugaaccuggccagccagaacuggaacaacuacgaccccaccgaggagauccccgcgccgcucgggacgcccgacuucgugggcaagauccaggggcugcugacccagaccacccgggccgacggcuccacgcgcgcccacaaggccaccgugagcaccgggagcguccacuucacccccaagcucggcuccgugcaguucagcacggacaccgacaacgacuuccagcccggccagaacaccaaguucaccccggugggggucauccaggacggcgaccggcaccagaacgagccccagcagugggugcugcccgacuacuccgggcgcacgggccacaacgugcaccuggcccccgcggucgccccgaccuuccccggggagcagcuccuguucuuccggagcaccaugcccggcugcuccggcuaccccaacaugaaccuggacugccuccugccgcaggagugggugcugcacuucuaccaggagagcgcccccgcccaguccgacguggcgcuccugcgcuucgucaaccccgacaccaaccgggugcuguucgagugcaagcuccacaagagcggguacaucacgguggcccacaccggccagcacgaccugauccugcccccgaacggguacuuccgcuucgacuccugggucaaccaguucuacacccucgcccccaugggcaacggggccggccggcgccgcuga

SEQ ID NO: 12801 - RNA, 1614 nt, Artificial Sequence
  derived and/or modified sequence opt1 from VP1__Norovirus_and/or_Norovirus-like__AF406793
augaagauggccagcuccgacgccaaccccagcgacggcuccaccgcgaaccuggugccggaggucaacaacgaggugauggcccucgagcccguggucggggccgccaucgccggccccguggcggggcagcagaacgugaucgaccccuggauccgcaacaacuucguccaggccccgggcggggaguucaccgugagccccacgaacgcccccggcgagauccugugguccgcgccccugggcccggaccucaaccccuaccugagccaccuggcccggauguacaacggguacgccggcggguucgaggugcaggucauccucgccggcaacgccuucaccgccgggaagaucaucuucgcggccgugccgcccaacuuccccaccgagggccugucccccagccaggugaccauguucccccacaucaucgucgacgugcgccagcuggagcccgugcucaucccgcugcccgacgcccggaacaacuucuaccacuacaaccaguccaacgacagcacgaucaagcugaucgccaugcucuacacgccccugcgcgccaacaacgcgggcgacgacgucuucaccguguccugccgggugcugacccgccccagcccggacuucgacuucaucuuccucgucccgcccaccguggagucccggaccaagcccuucaccgugcccauccugaccgucgaggagaugagcaacucccgcuuccccaucccccuggagaagcucuacacggggcccagcuccguguucgugguccagccgcagaacggccggugcaccaccgacggggugcugcugggcaccacgcagcucagcgccgucaacaucugcaccuuccgcggcgacgugacccacaucgccgggucccacgacuacaccaugaaccuggccagccagaacuggaacaacuacgaccccacggaggagauccccgccccgcugggcacccccgacuucguggggaagauccagggcaugcucacccagaccacgcgggaggacgggagcacccgcgcgaccaaggccaccgucuccacgggcagcgugcacuucacccccaagcugggcuccgugcaguacaccgccgacaccaacaacgacuuccagacggggcagaacaccaaguucacccccgucggcgugauccaggacgggagcaaccaccagaacgagccgcagcagugggugcugaccaacuacuccggccggacggggcacaacguccaccucgcccccgccguggcgcccaccuuccccggcgagcagcugcuguucuuccgcagcaccaugccgggcugcuccggguaccccaacaugaaccucgacugccugcugccccaggagugggugcagcacuucuaccaggaggccgcccccgcccagagcgacgucgcgcuccugcgguucgugaacccggacaccggccgcgugcuguucgagugcaagcuccacaaguccggguacgucaccguggcccacacgggcccccacgaccuggugaucccgcccaacggguacuuccgguucgaccccugggucaaccaguucuacacccuggcccccaugggcaacggcgccgggcgccggcgcuga

SEQ ID NO: 12802 - RNA, 1614 nt, Artificial Sequence
  derived and/or modified sequence opt1 from VP1__Norovirus_and/or_Norovirus-like__KX514223
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaccuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcacgaucaagcugaucgccaugcucuacacgccccugcgggccaacaaccccggcgacgacguguucaccguguccugccgcguccugacccggccgagccccgacuucgacuucaucuuccucgugccgcccaccguggagucccgcaccaagcccuucagcguccccauccugaccgugggcgagaugaccaacucccgguuccccaucaaccuggagcgccucuucacggggcccagcuccgcgaacgugguccagccgcagaacggccggugcaccaucgacggggagcugcugggcaccacccagcucagcuccgugaacaucugcacguuccgcggcgacgucacccacaucgggagcacccaccacuggaccaugaaccuggccagccccaacuggaacaacuacgaccccacggaggagaccccggcgccccugggcacccccgacuucguggggaagauccacggcaugcucacccagacgacccagggguccggcagcacccgggcccaccgcgccaccguguacgucggcuccgccgacuucacgcccaagcuggggaaggugcaguucgagaccgagaccgaccacgaccuggccauccggcagaacaccaaguucacgccggugggcgucauccaggagagcgaccaccaccgcgacgagccccagcaguggcggcuccccaacuacuccggggccaacaccuucaacgugcaccuggcccccgccguggcgccgaacuuccccgacgagcagcuccuguucuuccgcagcacccugcccggcugcgggggccaccccaacauggaccuggacugccuccugccgcaggaguggguccagcacuucuaccaggaggccgcccccgcccaguccgacguggcgcugcuccgguucgugaaccccgacaccagccgcguccuguucgagugcaagcugcacaaguccggcuacgugacgguggcccacaccgggcagcacgaccucgucaucccgcccaacggcuacuuccgguucgacagcugggugaaccaguucuacacccuggcccccauggggaacggcaccgggcgcaagcgcuga

SEQ ID NO: 12803 - RNA, 1614 nt, Artificial Sequence
  derived and/or modified sequence opt1 from VP1__Norovirus_and/or_Norovirus-like__KX514318
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccacguucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaaccccggcgacgacguguucaccgugagcugccgcguccugacccggccgucccccgacuucgacuucaucuuccucgugccgcccaccguggagagccgcacgaagcccuucuccguccccauccugaccgugggcgagaugaccaacagccgguuccccgugaaccuggagcgccucuucaccgggcccuccagcgccaacgucgugcagccgcagaacggccggugcaugaucgacgggguccugcugggcacgacccagcucucccccgugaacaucugcaccuuccgcggcgacgugacccaccccgggggcagcaagaucuacacgaugaaccuggccuccccgaacuggaacaacuacgaccccaccgaggagauccccgcgccccuggggaccccggacuucgucggcaagauccacgggaugcucacccagacgacccaggagaacggcagcacccgggcccaccgcgccaccguguacgugggcggggccaacuucacgcccaagcugggcaagguccaguucgagaccgacaccgaggacgaccuggccauccggcagaacaccaaguucacgcccgugggggugauccagagcuccgaccaccaccgcgacgagccccagcaguggcggcucccgaacuacagcggccgcgacacccccaacguccaccuggcccccaccguggcccccaacuucccgggggagcagcuccuguucuuccgguccacccugcccggcugcggcgggcaccccaacauggaccuggacugccuccugccccaggagugggugcagcacuucuaccaggaggcggccccggcccagagcgacgucacgcugcuccgcuucgugaaccccgacaccucccgggugcuguucgagugcaagcugcacaagagcggcuacgucaccguggcccacaccgggcagcacgaccucgugaucccgcccaacggcuacuuccgcuucgacuccugggucaaccaguucuacacgcuggcgcccauggggaacggcaccggccgcaagcgguga

SEQ ID NO: 12804 - RNA, 1614 nt, Artificial Sequence
  derived and/or modified sequence opt1 from VP1__Norovirus_and/or_Norovirus-like__AB186065
augaagauggccagcaacgacgugaaccccuccgacggcagcgccgcgaaccuggucccggaggugaacaacgaggugauggcccucgagcccgucgugggggccgccaucgccgcgcccguggccggccagcagaacaucaucgaccccuggauccgcaacaacuucguccaggcccccgggggcgaguucaccgugagcccccggaacgcccccggggagauccugugguccgcgccccugggcccggaccucaaccccuaccugucccaccugagccgcauguacaacggcuacgccgggggcuucgaggugcaggucauccucgccgggaacgccuucaccgccggcaaggugaucuucgcggccgugccgcccaacuucccgacggaggggcugucccccagccaggucaccauguucccccacaucaucguggacgugcggcagcuggagcccguccucaucccgcugcccgacgugcgcaacaacuucuaccacuacaaccaggcccacgacuccacccugaagcucaucgccaugcuguacacgccccugcgggccaacaacgcgggcgacgacguguucaccgucagcugccgcgugcucacccggcccuccccggacuucgacuucaucuuccuggugccgcccaccgucgagagccgcaccaaguccuucacggugcccgugcugaccgucgaggagaugaccaacagccgguuccccaucccccucgagaagcuguacaccggccccuccagcgccuucgugguccagccccagaacgggcgcugcacgaccgacggcgugcugcucgggaccacccagcuguccgccgugaacaucugcacguuccggggcgacgucacccacaucgccggcagccgcaacuacaccaugaaccuggccucccagaacuggaacaacuacgacccgaccgaggagauccccgcgccccucgggaucccggacuucgugggcaagauccaggggcugcugacgcagaccacccgggccgacggcagcacccgcgcccacaaggccacggugagcaccggguccguccacuucacccccaagcucggcagcgugcaguucuccaccgacacggacaacgacuuccagcccggccagaacaccaaguucacccccgugggggucauccaggacggcgaccggcaccagaacgagccgcagcagugggugcugcccgacuacagcgggcgcaccggccacaacgugcaccuggcccccgcggucgcccccacguucccgggggagcagcuccuguucuuccgguccaccaugcccggcugcagcggcuaccccaacaugaaccuggacugccuccugccccaggagugggugcugcacuucuaccaggaguccgccccggcccagagcgacguggcgcuccugcgcuucgucaaccccgacaccaaccgggugcuguucgagugcaagcuccacaaguccggguacaucaccguggcccacacgggccagcacgaccugauccugccgcccaacggguacuuccgcuucgacagcugggucaaccaguucuacacccucgcccccaugggcaacggggccggccggcgccgcuga

SEQ ID NO: 12805 - RNA, 1614 nt, Artificial Sequence
  derived and/or modified sequence opt1 from VP1__Norovirus_and/or_Norovirus-like__KX514307
augaagauggccagcuccgacgccaaccccagcgacggcuccaccgcgaaccuggugccggaggucaacaacgaggugauggcccucgagcccguggucggggccgccaucgccgcgcccguggugggccagcagaacgucaucgaccccuggauccgcaacaacuucgugcaggcccccgggggcgaguucaccgugagcccccggaacgcccccggggagauccugugguccgcgccccugggcccggaccucaaccccuaccugagccaccuggcccgcauguacaacggcuacgccgggggcuucgagguccaggugauccucgccgggaacgccuucacggccggcaagaucaucuucgcggccgugccgcccaccuucccgaccgaggggcugucccccagccaggucaccauguucccccacaucaucguggacgugcggcagcuggagcccguccucaucccgcugcccgacgugcgcaacaacuucuaccacuacaaccaguccaacgacagcacgaucaagcugaucgccaugcucuacacgccccugcgggccaacaaccccggcgacgacguguucaccgucuccugccgcgugcugacccggccgagccccgacuucgacuucaucuuccucgugccgcccaccgucgagucccgcaccaagcccuucagcgugcccauccugaccgugggcgagaugaccaacucccgguuccccaucaaccuggagcgccucuucacggggcccagcuccgccaacgucgugcagccgcagaacggccggugcaugaucgacgggguccugcugggcaccacccagcucagccccgugaacaucugcaccuuccgcggcgacgugacgcaccccgggggcuccaagaucuacaccaugaaccuggcgagcccgaacuggaacaacuacgaccccaccgaggagacccccgcgccccuggggacgccggacuucgucggcaagauccacgggaugcucacccagaccacccaggagaacggcagcacgcgggcccaccgcgccaccguguacgugggcggggccaacuucacccccaagcugggcaagguccgguucgagaccgacacgggggacgaccuggccauccgccagaacaccaaguucacccccgugggcgugauccaguccagcgaccaccaccgggacgagccccagcaguggcgccucccgaacuacuccggggccaacaccuucaacguccaccuggcccccgccguggcccccaacuuccccggcgagcagcuccuguucuuccggagcacgcugccgggcugcgggggccaccccaacauggaccuggacugccuccugccccaggagugggugcagcacuucuaccaggaggcggcccccgcccaguccgacgucgcccugcuccgcuucgugaacccggacaccagccgggugcuguucgagugcaagcugcacaaguccggguacgucaccguggcgcacaccggccaguacgaccucgugcugcccagcaacggguacuuccgcuucgacuccugggucaaccaguucuacacgcuggcccccaugggcaacggcaccgggcgccggcgcuga

SEQ ID NO: 12806 - RNA, 1614 nt, Artificial Sequence
  derived and/or modified sequence opt1 from VP1__Norovirus_and/or_Norovirus-like__LC048948
augaagauggccagcuccgacgccaaccccagcgacggcuccgcggccaaccuggugccggaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagccacgacuccacccugaagcucaucgccgugcuguacacgccccugcggaccaacaacgccggcgacgacguguucaccgucagcugccgcgugcucacccggcccuccccggacuucgacuucaucuuccuggugccgcccaccgucgagagccgcacgaagcccuucaccgugcccauccugaccguggaggagauguccaacagccgguuccccaucccccucgagaagcuguacaccggccccuccagcgcguucgucgugcagccgcagaacgggcgcugcacgaccgacggcguccugcucgggaccacccagcuguccgccgugaacaucugcaacuuccggggcgacgugacgcacaucgucggcagccacgagaccaccaugaaccuggccagccagaacugguccaacuacgaccccacccagaagauccccgccccgcucgggacgccccacuucgugggcaagauccaggggcugcugacccagaccacccgcgcccacggcagcacgcgggcgcacaaggccaccguguccaccgggagcguccacuucacccccaagcucggcuccgugcaguucacgaccgacaccaacaacgacuuccagaccggccagaacacgaaguucacccccgugggggucauccaggacggcgaccaccaccagaacgagccgcagcagugggugcugcccaacuacagcgggcgcaccggccacaacgugcaccuggcccccgccgucgcccccaccuucccgggggagcagcuccuguucuuccgguccacgaugcccggcugcagcggcuaccccaacaugaaccuggacugccuccugccccacgagugggugcugcacuucuaccaggaggcggccccggcccaguccgacguggcccuccugcgcuucgucaaccccgacaccgggcgggugcuguucgagugcaagcuccacaagagcggcuacaucaccguggcgcacaccgggcccuucgaccugggcaucccgcccaacggguacuuccgcuucgacuccugggucaaccaguucuacacccuggcccccaugggcaacggcacggggcggcgccgguga

SEQ ID NO: 12807 - RNA, 1614 nt, Artificial Sequence
  derived and/or modified sequence opt1 from VP1__Norovirus_and/or_Norovirus-like__LC048908
augaagauggccagcuccgacgccaaccccagcgacggcuccgcggccaaccuggugcccgaggucaacaacgaggugauggcccucgagcccguggucggggccgccaucgcggcccccguggccggccagcagaacaucaucgaccccuggauccgcaacaacuucgugcaggcccccgggggcgaguucaccgucagcccccggaacgcgcccggggagauccugugguccgcgccccugggcccggaccucaaccccuaccugagccaccugucccgcauguacaacggcuacgccgggggcuucgagguccaggugauccucgccgggaacgccuucaccgccggcaaggugaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagccacgacuccacccugaagcucaucgccaugcuguacacgccccugcgggccaacaacgcgggcgacgacguguucaccgugagcugccgcguccucacccggcccuccccggacuucgacuucaucuuccuggugccgcccaccguggagagccgcaccaagcccuucacgguccccauccugaccguggaggagauguccaacagccgguuccccaucccccucgagaagcuguacaccggccccuccagcgccuucgugguccagccgcagaacgggcgcugcaccacggacggcgugcugcucgggaccacccagcuguccgccgucaacaucugcaacuuccggggcgacgugacccacaucgugggcagccacgacuacacgaugaaccuggccagccagaacugguccaacuacgaccccaccgaggagauccccgccccgcucgggacccccgacuucgucggcaagauccaggggcugcugacccagacgacccgcgcgcacggcagcacccgggcccacaaggccaccguguccacggggagcgugcacuucacccccaagcucggcuccguccaguucaccaccgacacgaacaacgacuuccagaccggccagaacaccaaguucacccccgugggggugauccaggacggcgaccaccaccagaacgagccgcagcaguggguccugcccaacuacagcgggcgcacgggccacaacgugcaccuggcccccgccguggcgcccaccuucccgggggagcagcuccuguucuuccgguccaccaugcccggcugcagcggcuaccccaacaugaaccuggacugccuccugccccaggaguggguccugcacuucuaccaggagaccgccccggcccagcccgacguggcccuccugcgcuucgugaaccccgacacgucccggguccugugcgagugcaagcuccccaagagcggguacaucaccguggcgcacaccggcccguacgaccuggugaucccgcccaacggguacuuccgcuucgacuccugggucaaccaguucuacacccuggcccccaugggcaacgggaccggccggcgccgguga

SEQ ID NO: 12808 - RNA, 1614 nt, Artificial Sequence
  derived and/or modified sequence opt1 from VP1__Norovirus_and/or_Norovirus-like__KX514312
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccacguucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaaccccggcgacgacguguucaccguguccugccgcguccugacccggccgagccccgacuucgacuucaucuuccucgugccgcccaccguggagucccgcagcaagcccuucuccguccccgugcugacgguggaggagaugaccaacagccgguuccccgccacccuggacaagcuguucaccggccccuccagcacguucgucgugcagccgcagaacgggcgcugcaugaucgacggcguccugcuggggaccacccagcucucccccgugaacaucugcaccuuccggggcgacgugacgcaccccggcgggagcaagaucuacaccaugaaccuggccagcccgaacuggaacaacuacgaccccaccgaggagauccccgcgccccugggcaccccggacuucgucgggaagauccacggcaugcucacgcagaccacccaggagaacggguccacccgcgcccaccgggccacgguguacgugggcggcgccaacuucacccccaagcuggggaagguccaguucgagaccgacaccggcgacgaccuggccauccgccagaacacgaaguucacccccgugggggugauccagagcuccgaccaccaccgggacgagccccagcaguggcgccucccgaacuacagcggccgggacacccccaacguccaccuggcccccgccguggcgcccaccuucccgggggagcagcuccucuucuuccgcuccacgauccccggcugcggcgggcaccccaacaugaaccuggacugccugcucccccaggagugggugcagcacuucuaccaggaggccgccccggcccagagcgacgucgcgcugcugcgguucgugaaccccgacaccucccgcguccucuucgagugcaagcugcacaagagcggcuacgugaccguggcccacaccgggcagcacgaccuggugaucccgcccaacggcuacuuccgguucgacuccugggucaaccaguucuacacgcucgcccccauggggaacggcaccggccgcaagcgcuga

SEQ ID NO: 12809 - RNA, 1614 nt, Artificial Sequence
  derived and/or modified sequence opt1 from VP1__Norovirus_and/or_Norovirus-like__KX514237
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucguggggaacgccuucaccgccggcaagaucaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaacgcgggcgacgacguguucaccgucagcugccgcgugcugacccggcccuccccggacuucgacuucaucuuccucgugccgcccaccgucgagagccgcuccaagcccuucagcgugcccgugcugaccgucgaggagaugacgaacucccgguuccccgccacccuggacaagcuguucaccggccccagcuccaccuucgugguccagccccagaacgggcgcugcaugaucgacggcgugcugcuggggacgacccagcucagcccggugaacaucugcaccuuccggggcgacgucacccacccccgcgacucccccaucuacacgaugaaccuggccagcccgaacuggaacaacuacgaccccaccgaggagauccccgcgccccugggcaccccggacuucguggggaagauccagggcaugcucacccagacgacccaggggagcggcuccacccgggcccaccgcgccaccguguacgucgggagcgccgacuucacgcccaagcugggcaaggugcaguucgagaccgagaccgaccacgaccuggccauccggcagaacaccaaguucacgcccgugggcgucauccaggaguccgaccaccaccgcgacgagccccagcaguggcggcucccgaacuacagcggggccaacaccuucaacgugcaccuggcccccgcgguggcccccaacuuccccggcgagcagcuccucuucuuccgcuccacccugcuggggugcggcgggcacccgaacauggaccucgacugccugcugccccaggaguggguccagcacuucuaccaggaggccgcccccgcgcagagcgacguggcccuccugcgguucgugaaccccgacaccucccgcguccuguucgagugcaagcuccacaagagcggcuacgugacgguggcccacaccggccaguacgaccugguccugccguccaacggguacuuccgguucgacagcugggugaaccaguucuacacccucgcccccaugggcaacgggaccggccgccgccgguga

SEQ ID NO: 12810 - RNA, 1614 nt, Artificial Sequence
  derived and/or modified sequence opt1 from VP1__Norovirus_and/or_Norovirus-like__DQ419907
augaagauggccagcaacgacgccucccccagcgacggcuccaccgcgaaccuggugccggaggucaacaacgaggugauggcccucgagcccguggucggggccgccaucgccgcgcccguggccggccagcagaacgugaucgaccccuggauccgcaacagcuccguccaggcccccgggggcgaguucaccgugagcccccgggacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgccccgcccaacuucccgaccgaggggcugucccccagccaggugaccauguucccccacaucaucgugggcguccggcagcuggagcccgugcucaucccgcugcccgacgugcgcaacaacuucuaccacuacaaccaguccaacgacagcaccaucaagcugaucgccaugcucuacacgccccugcgggcgaacaacgccggcgacgacgucuucaccguguccugccgcgugcugacccggcccagcccggacuucgacuucaucuuccucgucccgcccaccguggagucccgcacgaagcccuucaccgugcccauccugaccgucgaggagaugaccaacagccgguuccccaucccccuggagaacugcucccgcgugcccgccgugccgcucagcuccaaccacaagaugcagugcacgaccgacgggguccugcugggcaccacccagcucagccccgugaacaucugcacguuccgcggggacgucacccacauccccggcacccggaccuaccggaugaaccuggccagccagaacuggaacaacuacgacccgacggaggagauccccgcgccccugggcacccccgacuucguggggaagauccagggcaugcucacccagaccacgaagggggacggcuccacccgcgggcacaaggccaccgugagcaccggcuccgucgacuucacgccgaagcugggcagcgugcaguucgccaccgacaccgacaacgacuucgagaccgggcagaacacgcgguucacccccgugggcgucauccaggacggguccagcacccaccgcaacgagccccagcagugggugcugcccgacuacuccggccggaccgugcacaacguccaccucgccccggccguggcccccacguuccccggggagcagcugcuguucuuccgcagcaccaugcccggcugcuccggcuacccgaacauggaccucgacugccugcugccccaggagugggugcagcacuucuaccaggaggcggcccccagccaguccgacgucgcccuccugcgguucgugaaccccgacaccgggcgcgugcuguucgagugcaagcuccacaaggccggcuacgucaccguggcgcacaccgggcagcacgaccuggugaucccgcccaacggcuacuuccgguucgacagcugggucaaccaguucuacacgcuggcccccauggggaacggcgccggccgccgccgguga

SEQ ID NO: 12811 - RNA, 1614 nt, Artificial Sequence
  derived and/or modified sequence opt1 from VP1__Norovirus_and/or_Norovirus-like__JN975543
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccagccugcccuccaacccccaguggcagaacgggcgcgugcacgucgacggcacccugcucggcaccaccccggugagcggguccugggucagcugcuucgcggccgaggccgccuacgaguuccaguccggcaccggggagguggccacguucacccugaucgagcaggacggcaccgcguacgugcccggggaccgggccgcgccccugggcuacccggacuucagcggccagcucgagaucgagguccagaccgagacgaccaaggccggggacaagcugaaggugaccaccuucgagaugauccugggccccacgaccaacguggaccaggcccccuaccaggggcgcgucuacgccuccaucaccgccauggccagccucgaccugguggacggccgggugcgcgccgucccccggagcaucuacuccuuccaggacgugaucccggaguacaacgacgggcugcucgugccccuggcgccgcccaucggccccuuccugcccggcgagguccuccugcgcuuccggaccuacaugcgccagcuggacacggccgacgccgccgccgaggcgaucgacugcgcccucccccaggaguucaucagcugguucgccuccaacgccuucaccgugcagagcgaggcccugcugcuccgguaccgcaacacccugaccgggcagcugcuguucgagugcaagcucuacuccgagggcuacaucgcgcugagcuacuccgggagcggcgcccugacguuccccaccgacggguucuucgagguggucuccugggugccgcgccucuaccagcuggccagcgugggcucccuggccaccggccgguga

SEQ ID NO: 12812 - RNA, 1614 nt, Artificial Sequence
  derived and/or modified sequence opt1 from VP1__Norovirus_and/or_Norovirus-like__JN975541
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccagccugcccuccaacccccaguggcagaacgggcgcgugcacgucgacggcacccugcucggcaccaccccggugagcggguccugggucagcugcuucgcggccgaggccgccuacgaguuccaguccggcaccggggagguggccacguucacccugaucgagcaggacggcaccgcguacgugcccggggaccgggccgcgccccugggcuacccggacuucagcggccagcucgagaucgagguccagaccgagacgaccaagaccggggacaagcugaaggugaccacguucgagaugauccugggccccaccaccaacguggaccaggcccccuaccaggggcgcgucuacgccuccaucaccgccgccgccagccucgaccugguggacggccgggugcgcgccgucccccggagcaucuacuccuuccaggacgcgaucccggaguacaacgacgggcugcucgugccccuggccccgcccaucggccccuuccugcccggcgaggugcuccugcgcuuccggacguacaugcgccagcuggacaccgccgacgccgccgcggaggccaucgacugcgcccucccccaggaguucaucagcugguucgccuccaacgccuucaccguccagagcgaggcgcugcugcuccgguaccgcaacacccugacggggcagcugcuguucgagugcaagcucuacuccgagggcuacaucgcccugagcuacuccgggagcggcgcccugaccuuccccaccgacggguucuucgaggugguguccugggucccgcgccucuaccagcuggccagcgugggcucccuggcgaccggccgguga

SEQ ID NO: 12813 - RNA, 1614 nt, Artificial Sequence
  derived and/or modified sequence opt1 from VP1__Norovirus_and/or_Norovirus-like__KF113526
augcgcaugagcgacggcgccgcccccaaggcgaacggguccgaggccagcggccaggaccuggugccgaccgccgucgagcaggccgugcccauccagcccguggccggggcgucccucgccgcccccgccgcgggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgccggcaacgcguucaccgccgggaaggugguggucgcccuggugccgcccuacuuccccaagggcucccugaccgccgcccagaucacgugcuucccccacgugaugugcgacguccgcacccucgagcccauccagcugccccugcucgacgugcggcgcgugcuguggcacgcgacccaggaccaggaggagagcaugcggcuggucugcaugcucuacaccccgcugcgcaccaacucccccggcgacgagagcuucgugguguccgggcggcugcucagcaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccucccugcccagcaacccccaguggcagaacgggcgcgugcacgucgacggcacccugcucggcacgaccccgguguccgggagcugggucuccugcuucgcggccgaggccgccuacgaguuccagagcggcaccggggagguggccaccuucacgcugaucgagcaggacggcuccgcguacgugcccggggaccgggccgcgccccugggcuacccggacuucagcggccagcucgagaucgagguccagaccgagaccaccaaggccggggacaagcugaaggugacgaccuucgagaugauccugggccccaccaccaacguggaccaggcccccuaccaggggcgcgucuacgccagccucacggccgccgccucccuggaccugguggacggccgggugcgcgcggucccccggagcaucuacggguuccaggaccagaucccggaguacaacgacggccuccuggugccccuggccccgcccgugggccccuuccuccccggggagcugcugcuccgcuuccggaccuacaugcgccagaucgacuccgccgacgccgccgcggaggccaucgacugcgcccugccccaggaguucaucagcugguucgccuccaacgccuucaccguccagagcgaggcgcugcuccugcgguaccgcaacacccugacgggccagcuccuguucgagugcaagcuguacuccgagggguacaucgcccugagcuacuccggcagcgggccccucaccuucccgaccgacggcuucuucgaggugguguccugggucccccgccuguaccagcuggccagcgugggcucccucgccaccgggcgguga

SEQ ID NO: 12814 - RNA, 1614 nt, Artificial Sequence
  derived and/or modified sequence opt1 from VP1__Norovirus_and/or_Norovirus-like__KF113527
augcgcaugagcgacggcgccgcccccaaggcgaacggguccgaggccagcggccaggaccuggugccgaccgccgucgagcaggccgugcccauccagcccguggccggggcgucccucgccgcccccgccgcgggccagaucaaccagaucgacccguggaucuuccagaacuucguccagugcccccugggggaguucagcaucagcccccggaacgcccccggcgagauccuguucgaccucgcccugggcccggggcugaaccccuaccucgcccaccuguccgccauguacaccggcuggguggggaacauggaggugcagcugguccucgcgggcaacgccuucacggccuccaaggugguggucgcccuggugccgcccuacuuccccaaggggagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcaccaacagccccggcgacgaguccuucguggugagcggccggcugcucuccaagcccgccgccgacuucaacuucgucuaccugacgcccccgaucgagcgcaccaucuaccggaugguggaccugcccgugcuccagccccgccugugcacccacgcccgguggcccgccccggucuacgggcugcucguggaccccagccugcccuccaacccccaguggcagaacggccgcgugcacgucgacgggacccugcucggcacgaccccggugagcggcuccugggucagcugcuucgcggccgaggccgccuacgaguuccaguccgggaccggcgagguggccaccuucacgcugaucgagcaggacgggagcgcguacgugcccggcgaccgggccgcgccccugggguacccggacuucagcggccagcucgagaucgagguccagaccgagaccaccaaggccggcgacaagcugaaggugacgaccuucgagaugauccuggggcccaccaccaacguggaccaggcccccuaccagggccgcgucuacgccucccucacggccgccgccagccuggaccugguggacgggcgggugcgcgcggucccccgguccaucuacggcuuccaggaccagaucccggaguacaacgacgggcuccuggugccccuggccccgcccgugggccccuuccuccccggcgagcugcugcuccgcuuccggaccuacaugcgccagaucgacagcgccgacgccgccgcggaggccaucgacugcgcccugccccaggaguucaucuccugguucgccagcaacgccuucaccguccaguccgaggcgcugcuccugcgguaccgcaacacccugacggggcagcuccuguucgagugcaagcuguacagcgagggcuacaucgcccuguccuacagcggguccggcccccucaccuucccgaccgacggguucuucgagguggugagcugggucccccgccuguaccagcuggccuccgugggcagccucgccaccggccgguga

SEQ ID NO: 12815 - RNA, 1614 nt, Artificial Sequence
  derived and/or modified sequence opt1 from VP1__Norovirus_and/or_Norovirus-like__KM458057
augcgcaugagcgacggcgccgcccccaaggcggacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccgccgacuucaacuucgucuaccugacgcccccgaucgagcgcaccaucuaccggaugguggaccugcccgugauccagccccgccucugcacccacgcccgguggcccgccccggucuacggccugcugguggaccccagccuccccuccaacccccaguggcagaacgggcgcgugcacgucgacggcacccugcugggcaccaccccggugagcggguccugggucagcugcuucgcggccgaggccgccuacgaguuccaguccggcaccggccagguggccacguucacccucaucgagcaggacgggagcgcguacgugcccggggaccgggccgcgccccugggcuacccggacuucuccggccagcuggagaucgagguccagaccgagaccacgaagaccggggacaagcucaaggugaccaccuucgagaugauccugggccccacgaccaacguggaccaggcccccuaccaggggaaggucuucgccagcaucaccgccgccgccagccuggaccucguggacggccgcgugcgggccgucccccgcuccaucuacggguuccaggacgugaucccggaguacaacgacggccugcuggugccccucgcgccgcccaucggccccuuccugcccggggagguccugcuccgguuccgcaccuacaugcggcagcuggacacggccgacgccgccgccgaggcgaucgacugcgcccugccccaggaguucaucagcugguucgccuccaacguguucaccgugcagagcgaggcccuccugcugcgcuaccggaacacccucaccggccagcugcuguucgagugcaagcuguacuccgagggguacaucgcccucagcuacuccggcagcgggccccugacguucccgaccgacggcuucuucgaggucguguccugggugccccgccuguaccagcucgcgagcgucggcucccuggccaccgggcgcuga

SEQ ID NO: 12816 - RNA, 1614 nt, Artificial Sequence
  derived and/or modified sequence opt1 from VP1__Norovirus_and/or_Norovirus-like__AB662855
augaagauggccagcaacgacgccgcgcccuccaccgacggcgccgccgggcuggugccggagagcaacaacgaggucauggcccucgagcccguggccggcgcggcccuggccgcccccgugaccgggcagacgaacaucaucgaccccuggauccgcgcgaacuucguccaggccccgaacggcgaguucaccgugagcccccggaacgcccccggggaggugcugcucucccuggagcugggccccgagcucaacccguaccuggcccaccuggcccgcauguacaacggccacgccgggggcauggagguccaggugaugcucgccgggaacgccuucaccgccggcaagcugguguucgccgcggucccgccccacuuccccguggagaaccugagcccccagcagaucaccauguucccccacgugaucaucgacguccggacgcucgagcccgugcugcugccccucccggacgugcgcaacaacuucuuccacuacaaccagaaggacgaccccaagaugcggaucgucgccaugcuguacacgccccugcgcuccaacggguccggcgacgacguguucaccgugagcugccggguccucacccgccccuccccggacuucgacuucaccuaccuggugccgcccaccguggagagcaagaccaagcccuucacccugcccauccucacgcugggcgagcuguccaacagccgguuccccgucuccaucgaccagauguacaccagccccaacgaggugaucuccgugcagugccagaacgggcgcugcacccucgacggcgagcugcaggggaccacgcagcugcaggucagcggcaucugcgccuucaagggcgaggugaccgcccaccuccacgacaacgaccaccuguacaacgucaccaucaccaaccugaacgggucccccuucgacccgagcgaggacgugcccgcgccccucggcgugccggacuuccaggggcgggucuucggcgugaucucccagcgcgacaagcagaacgcggccgggcacaacgagcccgccaaccggggccacgacgccgugguccccacguacaccgcccaguacacccccaagcugggccaggugcagaucgggaccuggcagacggacgaccuccaggugaaccagccggucaaguucacccccgugggccugaacgacaccgagcacuucaaccaguggguggucccccgcuacgcgggggcccugaaccugaacaccaaccucgcccccagcguggccccgguguuccccggcgagcggcugcuguucuuccgcagcuacaucccccucaagggcggguacggcaaccccgcgaucgacugccugcugccgcaggaguggguccagcacuucuaccaggaggccgcccccuccaugagcgagguggcccucgugcgguacaucaaccccgacacggggcgcgcccuguucgaggcgaagcugcaccgggccggcuucaugaccgucuccagcaacaccuccgcccccgugguggucccggccaacggguacuuccgcuucgacagcugggugaaccaguucuacucccucgcccccaugggcaccgggaacggcuga

SEQ ID NO: 12817 - RNA, 1614 nt, Artificial Sequence
  derived and/or modified sequence opt1 from VP1__Norovirus_and/or_Norovirus-like__AB809997
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgagcgcgaggggaccggcgaggccaagaacgccaagggggucuacaucuccaccacgagcggcaaguucacccccaagaucggcuccaucgggcugcacagcaucaccgagaacgugcacccgaaccagcagucccgguucacccccgucggcguggcccagaacgagaacacgcccuuccagcagugggugcugccccacuacgccggggcccucgcgcugaacaccaaccuggccccggccgucgcccccaccuuccccggcgagcagcuccuguucuuccgcagccgggugcccugcgugcaggggcugcgcggccaggacgcguucaucgacugccuccugccgcaggagugggucaaccacuucuaccaggaggccgcccccucccaggccgacguggcccugauccgguacgugaaccccgacaccggccgcacccucuucgaggcgaagcugcaccggagcggguucaucacggucucccacaccggcgccuacccccugguggugccgcccaacgggcacuuccgcuucgacagcugggucaaccaguucuacucccucgcccccaugggcaccgggaacggcuga

SEQ ID NO: 12818 - RNA, 1614 nt, Artificial Sequence
  derived and/or modified sequence opt1 from VP1__Norovirus_and/or_Norovirus-like__AB810001
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcggggccaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggguucaucacggugagccacaccggcgccuacccccugguggucccgcccaacgggcacuuccgguucgacuccugggugaaccaguucuacagccucgcccccaugggcaccgggaacggcuga

SEQ ID NO: 12819 - RNA, 1614 nt, Artificial Sequence
  derived and/or modified sequence opt1 from VP1__Norovirus_and/or_Norovirus-like__AB809992
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcggggccaggacgcguucaucgacugccuccugccgcaggaguggguggaccacuucuaccaggaggccgcccccagccaggccgacguggcccugauccgcuacgucaaccccgacaccggccggacccucuucgaggcgaagcugcaccgcuccggguucaucacggugagccacaccggcgccuacccccugguggucccgcccaacgggcacuuccgguucgacuccugggugaaccaguucuacagccucgcccccaugggcaccgggaacggcuga

SEQ ID NO: 12820 - RNA, 1611 nt, Artificial Sequence
  derived and/or modified sequence opt1 from VP1__Norovirus_and/or_Norovirus-like__AY130761
augaagauggccagcaacgacgccacccccuccgacgacggcgcggccgggcuggugccggagaucaacaacgaggucauggcccucgagcccguggccggcgccagcaucgcggcccccguggucgggcagcagaacaucaucgaccccuggauccgcaacaacuucgugcaggccccggccggcgaguucaccgugagcccccggaacucccccggggagcugcugcucgaccuggagcugggccccgagcucaacccguaccuggcgcaccuggcccgcauguacaacggccacgccgggggcauggagguccagaucgugcucgccgggaacgccuucacggcgggcaagauccuguucgccgccaucccgcccuccuuccccuacgagaaccugagccccgcccagcucaccaugugcccccacgugaucgucgacgugcggcagcuggagcccgugcugcuccccaugccggacauccgcaacgucuucuaccacuacaaccagaacaacucccccaagcugcggcugguggccaugcucuacacgccccugcgcgcgaacaacagcggggacgacguguucaccgucuccugccgggugcugacccgccccagcccggacuuccaguucaccuuccucgugccgcccaccgucgaguccaagaccaagaacuucacgcugcccgugcugcgggugagcgagaugaccaacucccgcuuccccgucgugcucgaccagauguacaccagccggaacgagaacaucaucgugcagccccagaacggccgcugcaccacggacggcgagcugcuggggaccaccacccuccaguccgucagcaucugcaacuuccggggcacgaugcaggccaagcugaacgagcagccccgcuaccagcugcagcucaccaaccuggacgggucccccaucgacccgaccgacgacaugcccgcgccccugggcaccccggacuuccaggccaugcucuacggcguggccagccagcgguccagccgcgacaacgccacgcgggcccacgacgcccagaucgacaccgccggggacaccuucgcccccaagaucggccagguccgcuucaagagcuccagcgacgacuucgaccugcacgaccccaccaaguucacgcccaucggggugaacguggacgaccagcacccguuccggcaguggucccugcccaacuacggcgggcaccucgcgcugaacaaccaccuggcccccgccgucacgccccucuucccgggcgagcagauccuguucuuccgcagccacauccccuccgccggcgggcacaccgacggcgcgaucgacugccugcucccccaggaguggaucgagcacuucuaccaggaggccgcccccagccaguccgacaucgcccuggugcgguucaucaacccggacaccgggcgcgugcugcucgaggccaagcugcacaagcagggcuuccugaccgucgcggccagcggggaccaccccaucgugaugcccaccaacggcuacuuccgcuucgaggccugggugaaccccuucuacacccucgccccggucggcaccggguccggccggcgccggauccaguga

SEQ ID NO: 12821 - RNA, 1611 nt, Artificial Sequence
  derived and/or modified sequence opt1 from VP1__Norovirus_and/or_Norovirus-like__KF806495
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucacgguccccgugcugaccguggaggagaugaccaacucccgguuccccaucccccuggagaagcuguucaccggccccagcuccgccuucgucgugcagccgcagaacgggcgcugcacgaccgacggcguccuccuggggaccacccagcucagcgccgugaacaucugcacguuccggggcgacgugacccacgucuccgacaagaccuucgccaugaaccuggcgagccccaacuggaacaacuacgaccccaccgaggacaucccggcgccccugggcacgcccgacuucguggggcgcauccacggcaugcucacccagaccacccggcgcgacggggccacgcggggccacaaggccaccguguccaccgggggcgccgacuucacccccaagcugggcagcguccgcuacaucacggacaccaccgacgaccuggaggugcgggagaacaccaaguucacgccgaucggggugcuccacagcuccggcgagcaccgcgccgagcccgaccaguggcggcugcccgaguacagcgggcgcaacguccacaacgugcaccuggcccccgccguggccccgaccuuccccggcgagcagcuccuguucuuccgguccgcgcugcccgggugcggcggcuaccccaacaccgaccucgacugccugcugccgcaggaguggguccagcacuucuaccaggaggccgcccccgcccagagcgacguggcccuccugcgcuucgugaaccccgacaccgggcgcguccuguucgagugcaagcuccacaaguccggcuacgugacgguggcgcacaccgggccccacgaccuggucaucccgcccaacggcuacuuccgguucgacagcugggugaaccaguucuacacccuggcccccauggggaacggcaccggccgccggcgcuga

SEQ ID NO: 12822 - RNA, 1611 nt, Artificial Sequence
  derived and/or modified sequence opt1 from VP1__Norovirus_and/or_Norovirus-like__KF806503
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaucaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucaccguccccgugcugacgguggacgagaugaccaacucccgguuccccaucccccuggagaagcuguucaccggccccagcuccgccuucgucgugcagccgcagaacgggcgcugcaccacggacggcguccuccuggggaccacccagcucagcgccgugaacaucugcaccuuccggggcgacgugacgcacgucuccgacaagaccuucgccaugaaccuggcgagccccaacuggaacaacuacgaccccaccgaggagaucccggcgccccugggcacccccgacuucguggggcgcauccacggcaugcucacgcagaccacccggcgcgacggggccacccggggccacaaggccacgguguccaccgggggcgccgacuucacccccaagcugggcagcguccgcuacaucaccgacacgaccgacgaccuggaggugcgggagaacaccaaguucaccccgaucggggugcuccacagcuccggcgagcaccgcgccgagcccgaccaguggcggcugcccgaguacagcgggcgcaacguccacaacgugcaccuggcccccgccguggccccgacguuccccggcgagcagcuccuguucuuccgguccgcgcugcccgggugcggcggcuaccccaacaccgaccucgacugccugcugccgcaggaguggguccagcacuucuaccaggaggccgcccccgcccagagcgacguggcccuccugcgcuucgugaaccccgacaccgggcgcguccuguucgagugcaagcuccacaaguccggcuacgugaccguggcgcacacggggccccacgaccuggucaucccgcccaacggcuacuuccgguucgacagcugggugaaccaguucuacacccuggcccccauggggaacggcaccggccgccggcgcuga

SEQ ID NO: 12823 - RNA, 1611 nt, Artificial Sequence
  derived and/or modified sequence opt1 from VP1__Norovirus_and/or_Norovirus-like__KF712506
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggaggugcugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucuccacggaggggcugagcccgucccaggugaccauguucccccaccugaucgucgacgugcggcagcucgagcccgugaugaucccccugccggacauccgcaacaacuucuaccacuacaaccagagcaacgaccccaccaucaagcugaucgcgaugcucuacacgccccugcgggccaacaacgucggcgacgacguguucaccguguccugccgcguccugacccggcccagcccggacuucgacuucaucuuccucgugccgcccaccguggaguccaagaccaaccccuucagcguccccauccugacgaucgaggagaugaccaacucccgcuuccccaucccccuggagaagcuguucaccggccccagcuccgcccucguggugcagccgcagaacgggcggugcaccacggacggcguccugcucgggaccacccagcugagccccgugaacaucugcaccuuccgcggcgacgucacgcacaccaccaagacccacacguaccagaugaaccuggccgcccagaacuggaacuccuacgaccccaccgaggagaucccggcgccccucggcacccccgacuucguggggaagauccagggcgugcugacccagacgaccaaggagaacgggagcacccgggcccacaaggccaccgucuacacgggcaccguggaguucacccccaagcuggggcgcauccagcuguucaccgacacggacaacgaccucgaggccaaccagaacaccaaguucaccccggugggcgucauccaggacggcgaccaccagaacgagccccagcagugggugcugcccagcuacuccgggcggaacaaccacaacgugcaccucgcccccgcggucgccccgaccuuccccggcgagcagcugcuguucuuccgcagcacgaugcccgggugcuccggcuaccccaacaugaaccucgacugccugcugccgcaggagugggugcaguacuucuaccaggaggccgcccccgcgcagagcgacguggcccuccugcgguucgucaaccccgacaccgggcgcgugcuguucgagugcaagcuccacaaguccggcuacgugaccgucgcccacaccggccaccacgaccuggugaucccgcccaacggguacuuccgguucgacagcugggugucccccuucuacacccuggcccccaugggcaacgggacgggccgccggcgcuga

SEQ ID NO: 12824 - RNA, 1611 nt, Artificial Sequence
  derived and/or modified sequence opt1 from VP1__Norovirus_and/or_Norovirus-like__KF712507
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggaggugcugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucuccacggaggggcugagcccgucccaggugaccauguucccccaccugaucgucgacgugcggcagcucgagcccgugaugaucccccugccggacauccgcaacaacuucuaccacuacaaccagagcaacgaccccaccaucaagcugaucgcgaugcucuacacgccccugcgggccaacaacgucggcgacgacguguucaccguguccugccgcguccugacccggcccagcccggacuucgacuucaucuuccucgugccgcccaccguggaguccaagaccaaccccuucagcguccccauccugacgaucgaggagaugaccaacucccgcuuccccaucccccuggagaagcuguucaccggccccagcuccgcccucguggugcagccgcagaacgggcggugcaccacggacggcguccugcucgggaccacccagcugagccccgugaacaucugcaccuuccgcggcgacgucacgcacaccaccaagacccacacguaccagaugaaccuggccgcccagaacuggaacuccuacgaccccaccgaggagaucccggcgccccucggcacccccgacuucguggggaagauccagggcgugcugacccagacgaccaaggggaacggcagcacccgggcccacaaggccaccgucuacacggggaccguggaguucacccccaagcugggccgcauccagcuguucaccgacacggacaacgaccucgaggccaaccagaacaccaaguucaccccggugggcgucauccaggacggggaccaccagaacgagccccagcagugggugcugcccagcuacuccggccggaacaaccacaacgugcaccucgcccccgcggucgccccgaccuuccccggggagcagcugcuguucuuccgcagcacgaugcccggcugcuccggguaccccaacaugaaccucgacugccugcugccgcaggagugggugcaguacuucuaccaggaggccgcccccgcgcagagcgacguggcccuccugcgguucgucaaccccgacaccggccgcgugcuguucgagugcaagcuccacaaguccggcuacgugaccgucgcccacaccgggcaccacgaccuggugaucccgcccaacggcuacuuccgguucgacagcugggugucccccuucuacacccuggcccccauggggaacggcacggggcgccggcgcuga

SEQ ID NO: 12825 - RNA, 1611 nt, Artificial Sequence
  derived and/or modified sequence opt1 from VP1__Norovirus_and/or_Norovirus-like__JX401281
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccaugccccuguccccggagcucaaccccuaccugagccaccugucccgcauguacaacggcuacgccggcggguucgaggugcaggucauccucgccggcaacgccuucaccgccgggaagaucaucuucgcggccaucccgcccaacuucccgacggacggccugagccccucccaggugaccauguucccccacaucaucguggacguccggcagcuggagcccgugcucaucccgcugcccgacgugcgcaacaacuucuaccacuacaaccaggccaacgacagcacccugaagcucaucgccaugcuguacacgccccugcgggccaacaacgcgggggacgacgucuucaccguguccugccgcgugcucacccggcccagcccggacuucgacuucaucuuccuggucccgcccaccguggagucccgcaccaagcccuucacggugcccauccugaccgucgacgagaugaccaacagccgguuccccacgccccucgagaagcugcacaccggccccaacaacuccaucguggugcagccgcagaacggccgcugcaccaucgacgggguccugcucggcaccacccagcugagcacggugaacaucugcaacuuccggggguccaccacccgcgccggccagagccacgccuacaccaugaaccuggucucccagaacuggaacaacuacgaccccacggaggagauccccgccccgcucggcacccccgacuucguggggaagaucgugggcaugcugagccagaccacccgggagaacagcuccacgcgcgcccacaaggcgaccgucagcaccggggacgcccacuucacccccaaguccggcagcgugcuguucacgaccgacaccgacgaccuccagaacgggcagaacacccgguucacgcccgugggcgucgcccaggacggcgagccgcaccagaacgagccccagcaguggcgccugcccaacuacuccgggacccccggccacaacgugcaccuggccccgcccguggcccccaccuuccccggggagcagcuccuguucuuccggagcaccaugccgggcugcgggggcuaccccaacauggaccuggacugccuccugccccaggaguggguccgccacuucuaccaggaggcggcccccgcccaguccgacguggcccugcuccgguucgugaacccggacacgggccgcguccuguucgagugcaagcugcacaaggcgggguacaucaccgugagccacaccggccccuacgaccucgugaucccgcccaacggguacuuccgguucgacuccugggucaaccaguucuacgcccuggcccccaugggcaccgggaccggccgccgccgguga

SEQ ID NO: 12826 - RNA, 1611 nt, Artificial Sequence
  derived and/or modified sequence opt1 from VP1__Norovirus_and/or_Norovirus-like__KF806526
augaagauggccagcaacgacgccucccccagcgacggcuccgcggccaaccuggugccggaggucaacaacgaggugauggcccucgagcccguggucggggccgccaucgcggcccccguggccggccagcagaacgugaucgaccccuggauccgcaacaaguucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucgucguggacgugcggcagcuggagcccguccucaucccgcugcccgacgugcgcaacaacuucuaccacuacaaccaguccaaggaccccaccaucaagcugaucgccaugcucuacacgccccugcgggcgaacaacgccggcgaggacguguucaccgucagcugccgcgugcugacccggccgucccccgacuucgacuucaucuuccucgugccgcccaccgucgagagccgcuccaagcccuucaccgugcccauccugacgguggaggagaugaccaacagccgguuccccaucccccuggagaagcuguucaccggcccguccggggccuucgucgugcagccccagaacggccgcugcaccacggacgggguccuccugggcaccacccagcucagccccgugaacaucugcaccuuccggggcgaccugacgcacuucgccgggacccacgaguacgccaugaaccuggcgucccagaacuggaacaacuacgacccgaccgaggagauccccgcgccccucggcgcccccgacuucguggggaagauccgcggcguccugacccagacgacccggcgcgacgggagcacccggggccaccgcgccacccuguccacgggcagcgcccacuucaccccgaagcucgggagcauccgguucuccaccgacaccaacaacgacuucgaggccggccagaacacgaaguucacccccguggggguguuccaggacggcgacaaccaccagaacgagccccagcaguggguccugcccaacuacagcggggccaccgcccacaacgugcaccuggccccggcgguggcccccgccuuccccggcgagcagcuccuguucuuccgcuccaccaugcccggcugcagcggguacccgaacaugaaccuggacugccuccugccccaggaguggguccagcacuucuaccaggaggccgcccccgcgcaguccgacguggcccugcuccgguucgugaaccccgacacgagccgcguccuguucgagugcaagcugcacaaguccggcuacgugaccguggcccacaccgggcagcacgaccucgucaucccgcccaacggcuacuuccgguucgacagcugggugaaccaguucuacacccuggcccccauggggaacggcacgggccgccgcuga

SEQ ID NO: 12827 - RNA, 1611 nt, Artificial Sequence
  derived and/or modified sequence opt1 from VP1__Norovirus_and/or_Norovirus-like__KF806500
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaaggugaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggcgaacaacgccggcgacgacguguucaccgucagcugccgcgugcugacccggcccuccccggacuucgacuucaucuuccucgugccgcccaccgucgagagccgcaccaagcccuucuccgugcccgugcugacggucgaggagaugaccaacagccgguuccccaucccccuggagaagcuguucaccggccccuccagcgccuucgugguccagccgcagaacgggcgcugcaccacggacggcgugcuccuggggaccacccagcucuccgccgugaacaucugcaccuuccggggcgacgucacgcacguggccggcgacaccuucgcgaugaaccuggccagccugaacuggaacaacuacgaccccaccgaggagacccccgccccgcucgggacgcccgacuucgugggccgcauccacgggaugcugacccagaccacccgguccgacggcgccacgcgcgcccacaaggcgaccgucagcaccgggggcgccgacuucacccccaagcugggcagcgugcgguacuccacggacaccagcuccgaccucgaggugcgcgagaacaccaaguucacccccaucgggguccugcacagcuccggcgggcaccgggccgagccggaccaguggcgccugcccgaguacagcggccggaacgugcacaacgugcaccucgcccccgcggucgcccccacguucccgggggagcagcugcuguucuuccgcuccaccaugcccggcugcggcggguaccccaacauggaccucgacugccugcugccccaggagugggugcagcacuucuaccaggaggccgccccggcccagagcgacguggcgcuccugcgguucgucaaccccgacaccggccgcgugcuguucgagugcaagcuccacaaguccggguacgugaccgucgcccacacgggcccccacgaccuggugaucccgcccaacggguacuuccgcuucgacagcugggugaaccaguucuacacccuggcccccaugggcaacggcaccgggcggcgccgguga

SEQ ID NO: 12828 - RNA, 1611 nt, Artificial Sequence
  derived and/or modified sequence opt1 from VP1__Norovirus_and/or_Norovirus-like__KF806498
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaaggacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccgugcugacgguggaggagaugaccaacagccgguuccccaucccccuggagaagcuguucaccggccccuccagcgccuucgucgugcagccgcagaacgggcgcugcaccacggacggcguccuccuggggaccacccagcucuccgccgugaacaucugcaccuuccggggcgacgugacgcacgucgccggcgacaccuucgcgaugaaccuggccagccugaacuggaacaacuacgaccccaccgaggagacccccgccccgcucgggacgcccgacuucgugggccgcauccacgggaugcugacccagaccacccgguccgacggcgccacgcgcgcccacaaggcgaccgugagcaccgggggcgccgacuucacccccaagcugggcagcguccgguacuccacggacaccagcuccgaccucgaggugcgcgagaacaccaaguucacccccaucggggugcugcacagcuccggcgggcaccgggccgagccggaccaguggcgccugcccgaguacagcggccggaacguccacaacgugcaccucgcccccgcgguggcccccacguucccgggggagcagcugcuguucuuccgcuccaccaugcccggcugcggcggguaccccaacauggaccucgacugccugcugccccaggaguggguccagcacuucuaccaggaggccgccccggcccagagcgacguggcgcuccugcgguucgugaaccccgacaccggccgcguccuguucgagugcaagcuccacaaguccggguacgugaccguggcccacacgggcccccacgaccuggucaucccgcccaacggguacuuccgcuucgacagcugggugaaccaguucuacacccuggcccccaugggcaacggcaccgggcggcgccgguga

SEQ ID NO: 12829 - RNA, 1611 nt, Artificial Sequence
  derived and/or modified sequence opt1 from VP1__Norovirus_and/or_Norovirus-like__KF429768
augaagauggccagcuccgacgccaaccccagcgacggcuccaccgcgaaccuggugccggaggccaacaacgaggucauggcccucgagcccguggugggggccgccaucgcggcccccgucgccggccagcagaacgugaucgaccccuggauccgcaacaacuucgugcaggcccccgggggcgaguucaccgucagcccccggaacgcgcccggggaggugcugugguccgcgccccugggcccggaccucaaccccuaccugagccaccuggcccgcauguacaacggcuacgccgggggcuucgaggugcaggucauccucgccgggaacgccuucgccgccggcaagaucaucuucgccgccgugccgcccaacuucuccacggaggggcugagcccgucccaggugaccauguucccccaccugaucgucgacgugcggcagcucgagcccgugaugaucccccugccggacauccgcaacaacuucuaccacuacaaccagagcaacgaccccaccaucaagcugaucgcgaugcucuacacgccccugcgggccaacaacgucggcgacgacguguucaccguguccugccgcguccugacccggcccagcccggacuucgacuucaucuuccucgugccgcccaccguggaguccaagaccaaccccuucagcguccccauccugacgaucgaggagaugaccaacucccgcuuccccaucccccuggagaagcuguucaccggccccagcuccgcccucguggugcagccgcagaacgggcggugcaccacggacggcguccugcucgggaccacccagcugagccccgugaacaucugcaccuuccgcggcgacgucacgcacaccaccaagacccacacguaccagaugaaccuggccgcccagaacuggaacuccuacgaccccaccgaggagaccccggcgccccucggcacccccgacuucguggggaagauccagggcgugcugacgcagaccaccaaggggaacggcagcacccgggcccacaaggccacggucuacaccgggaccguggaguucacccccaagcugggccgcauccagcuguucacggacaccgacaacgaccucgaggccaaccagaacaccaaguucaccccggugggcgucauccaggacggggaccaccagaacgagccccagcagugggugcugcccagcuacuccggccggaacaaccacaacgugcaccucgcccccgcggucgccccgacguuccccggggagcagcugcuguucuuccgcagcaccaugcccggcugcuccggguaccccaacaugaaccucgacugccugcugccgcaggagugggugcaguacuucuaccaggaggccgcccccgcgcagagcgacguggcccuccugcgguucgucaaccccgacaccggccgcgugcuguucgagugcaagcuccacaaguccggcuacgugaccgucgcccacaccgggcaccacgaccuggugaucccgcccaacggcuacuuccgguucgacagcugggugucccccuucuacacgcuggcccccauggggaacggcaccgggcgccggcgcuga

SEQ ID NO: 12830 - RNA, 1611 nt, Artificial Sequence
  derived and/or modified sequence opt1 from VP1__Norovirus_and/or_Norovirus-like__KF806496
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaaggacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccgugcugacgguggaggagaugaccaacagccgguuccccaucccccuggagaagcuguucaccggccccuccagcgccuucgucgugcagccgcagaacgggcgcugcaccacggacggcguccuccuggggaccacccagcucuccgccgugaacaucugcaccuuccggggcgacgugacgcacgucgccggcgacaccuucgcgaugaaccuggccagccugaacuggaacaacuacgaccccaccgaggagacccccgccccgcucgggacgcccgacuucgugggccgcauccacgggaugcugacccagaccacccgguccgacggcgccacgcgcgcccacaaggcgaccgugagcaccgggggcgccgacuucacccccaagcugggcagcguccgguacuccacggacaccagcggggaccucgaggugcgcgagaacaccaaguucacccccaucggcgugcugcacuccagcggggagcggcgcgccgagccggagcaguggcggcugcccgaguacuccggccgcaacguccacaacgugcaccucgcccccgcgguggcccccacguucccgggggagcagcugcuguucuuccggagcaccaugcccggcugcggcggguaccccaacauggaccucgacugccugcugccccaggaguggguccagcacuucuaccaggaggccgccccggcccaguccgacguggcgcuccugcgcuucgugaaccccgacaccggccgcguccuguucgagugcaagcuccacaagagcggguacgugaccguggcccacacgggcccccacgaccuggucaucccgcccaacggguacuuccgguucgacuccugggugaaccaguucuacacccuggcccccaugggcaacggcaccgggcgccggcgcuga

SEQ ID NO: 12831 - RNA, 1611 nt, Artificial Sequence
  derived and/or modified sequence opt1 from VP1__Norovirus_and/or_Norovirus-like__KF806499
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugucccaccuggcccgcauguacaacggcuacgccgggggcuucgagguccagguggugcucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaaggacuccaccaucaagcugaucgccaugcucuacacgccccugcgggcgaacaacgccggcgacgacguguucaccgugagcugccgcguccugacccggcccuccccggacuucgacuucaucuuccucgugccgcccaccguggagagccgcaccaagcccuucuccguccccgugcugacgguggaggagaugaccaacagccgguuccccaucccccuggagaagcuguucaccggccccuccagcgccuucgucgugcagccgcagaacgggcgcugcaccacggacggcguccuccuggggaccacccagcucuccgccgugaacaucugcaccuuccggggcgacgugacgcacgucgccggcgacaccuucgcgaugaaccuggccagccugaacuggaacaacuacgaccccaccgaggagacccccgccccgcucgggacgcccgacuucgugggccgcauccacgggaugcugacccagaccacccgguccgacggcgccacgcgcgcccacaaggcgaccgugagcaccgggggcgccgacuucacccccaagcugggcagcguccgguacuccacggacaccagcuccgaccucgaggugcgcgagaacaccaaguucacccccaucggggugcugcacagcuccggcgggcaccgggccgagccggaccaguggcgccugcccgaguacagcggccggaacguccacaacgugcaccucgcccccgcgguggcccccacguucccgggggagcagcugcuguucuuccgcuccaccaugcccggcugcggcggguaccccaacauggaccucgacugccugcugccccaggaguggguccagcacuucuaccaggagaccgccccggcccagagcgacguggcccuccugcgguucgugaaccccgacaccggccgcguccuguucgagugcaagcuccacaaguccggguacgugacgguggcgcacaccggcccccacgaccuggucaucccgcccaacggguacuuccgcuucgacagcugggugaaccaguucuacacccuggcccccaugggcaacggcaccgggcggcgccgguga

SEQ ID NO: 12832 - RNA, 1611 nt, Artificial Sequence
  derived and/or modified sequence opt1 from VP1__Norovirus_and/or_Norovirus-like__KF806497
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccaucagcccccggaacgcgcccggggagauccugugguccgcgccccugggcccggaccucaaccccuaccugagccaccuggcccgcauguacaacggcuacgccgggggcuucgagguccagguggugcucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaaggacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagcgccgugaacaucugcaccuuccggggcgacgugacgcacgucgccggcgacaccuucgcgaugaaccuggccucccugaacuggaacaacuacgaccccaccgaggagacccccgccccgcucgggacgcccgacuucgugggccgcauccacgggaugcugacccagaccacccggagcgacggcgccacgcgcgcccacaaggcgaccgugagcaccgggggcgccgacuucacccccaagcugggcuccguccgguacagcacggacaccuccagcgaccucgaggugcgcgagaacaccaaguucacccccaucggggugcugcacuccagcggcgggcaccgggccgagccggaccaguggcgccugcccgaguacuccggccggaacguccacaacgugcaccucgcccccgcgguggcccccacguucccgggggagcagcugcuguucuuccgcagcaccaugcccggcugcggcggguaccccaacauggaccucgacugccugcugccccaggaguggguccagcacuucuaccaggaggccgccccggcccaguccgacguggcgcuccugcgguucgugaaccccgacaccggccgcguccuguucgagugcaagcuccacaagagcggguacgugaccguggcccacacgggcccccacgaccuggucaucccgcccaacggguacuuccgcuucgacuccugggugaaccaguucuacacccuggcccccaugggcaacggcaccgggcggcgccgguga

SEQ ID NO: 12833 - RNA, 1611 nt, Artificial Sequence
  derived and/or modified sequence opt1 from VP1__Norovirus_and/or_Norovirus-like__JN699046
augaugauggccagcaaggacgccucccccagcgcggacggcgccaacggggccggccagcuggugccggaggucaacaacgccgagccccucccccuggaccccguggccggggcguccaccgcccuggccaccgccggccaggugaacaugaucgacccguggaucuucaacaacuucguccaggcgccccagggggaguucacgaucagccccaacaacacccccggcgacauccucuucgaccugcagcugggcccgcaccucaaccccuuccuggcccaccugucccagauguacaacgggugggugggcaacaugcgcgugcgggucauccucgccgggaacgccuucaccgccggcaaggugaucaucugcugcgugccgcccggguuccagagccgcacccuguccaucgcgcaggccacgcuguucccccacaucaucgccgacguccggacccucgagcccaucgagaucccccuggaggacgugcgcaacacccuguaccacaccaacgacaaccagcccacgaugcggcuccugugcaugcuguacaccccgcuccgcaccggcggcgggagcggcgggaccgacgccuucguggucgccggccgggugcugacgugccccuccagcgacuucaacuuccuguuccucgugccgcccaccgucgagcagaagacccgccccuucuccgugcccaacaucccccugcagcugcucagcaacucccgggugcccaaccugauccagagcaugguccuguccccggaccaggcgcagaacgugcaguuccagaacggccgcugcaccacggacgggcagcuccugggcaccacccccgugagcgucucccagauccugaaguuccgggggaaggugagcgccggcucccgcgugaucaaccucaccgagcuggacgggagccccuuccuggccuucgaggcccccgccccgacgggcuuccccgaccucggcaccagcgacuggcacgucgagaugucccugaacagcaacucccagagcuccgggaaccccauccugcuccgggacauccagccgaacagcuccgacuucgugccccaccugggcagcgucuccgugaccaccgcgaucgacguggccggggacuacacgggcaccauccaguggaccagccagcccuccaacgucacccccgugccggacgugaacuucuggacgaucccccaguacgggagcaaccuggccgaggccucccagcucgcccccgucguguacccgcccggcuucggcgaggcgaucguguacuucaugagccccauccccgggcccaacaccgcccacaagccgaaccugguccccugccugcucccccaggaguucgugacccacuucguguccgagcaggcccccagcaugggcgaggccgcgcugguccacuacguggacccggacaccaaccgcaaccugggggaguucaagcucuaccccgagggcuucaucacgugcgugcccaacgggaccggcccccagcagcugccgcugaacggcgucuucguguucgccuccugggugagccgguucuaccagcucaagcccgucgggaccgccuccagcgcccgcuga

SEQ ID NO: 12834 - RNA, 1611 nt, Artificial Sequence
  derived and/or modified sequence opt1 from VP1__Norovirus_and/or_Norovirus-like__AM263418
augaugauggccagcaaggacgccucccccagcgcggacggcgccaacggggccggccagcuggugccggaggucaacaacgccgagccccucccccuggaccccguggccggggcguccaccgcccuggccaccgccggccaggugaacaugaucgacccguggaucuucaacaacuucguccaggcgccccagggggaguucacgaucagccccaacaacacccccggcgacauccucuucgaccugcagcugggcccgcaccucaaccccuuccuggcccaccugucccagauguacaacgggugggugggcaacaugcgcgugcgggucauccucgccgggaacgccuucaccgccggcaaggugaucgugugcugcgucccgcccggguuccagagccgcacccuguccaucgcgcaggccacgcuguucccccacaucaucgccgacgugcggacccucgagcccaucgagaucccccuggaggacgugcgcaacacccuguaccacaccaacgacaaccagcccacgaugcggcuccugugcaugcuguacaccccgcuccgcaccggcggcgggagcggcgggaccgacgccuucgucguggccggccgggugcugacgugccccuccagcgacuucaacuuccuguuccucgucccgcccaccguggagcagaagacccgccccuucuccgugcccaacaucccccugcagcugcucagcaacucccggguccccaaccugauccagagcauggugcuguccccggaccaggcgcagaacgugcaguuccagaacggccgcugcaccacggacgggcagcuccugggcaccacccccgucagcgugucccagauccugaaguuccgggggaaggugagcgccggcucccgcgucaucaaccucaccgagcuggacgggagccccuuccuggccuucgaggcccccgccccgacgggcuuccccgaccucggcaccagcgacuggcacguggagaugucccugaacagcaacucccagagcuccgggaaccccauccugcuccgggacauccagccgaacagcuccgacuucgucccccaccugggcagcguggcggugaccaccgccaucgacgucgccggggacuacacgggcaccauccaguggaccucccagcccagcaacgugacccccgugccggacgucaacuucuggacgaucccccaguacggguccaaccuggccgaggccagccagcucgcgcccgugguguacccgcccggcuucggcgaggccaucgucuacuucaugucccccauccccgggcccaacaccgcccacaagccgaaccuggugcccugccugcucccccaggaguucgugacccacuucgucagcgagcaggcccccuccaugggcgaggcggcccuggugcacuacguggacccggacaccaaccgcaaccugggggaguucaagcucuaccccgagggcuucaucacgugcguccccaacgggaccggcccccagcagcugccgcugaacggcguguucguguucgccagcugggucucccgguucuaccagcucaagcccguggggaccgccagcuccgcccgcuga

SEQ ID NO: 12835 - RNA, 1611 nt, Artificial Sequence
  derived and/or modified sequence opt1 from VP1__Norovirus_and/or_Norovirus-like__KT732278
augaugauggccagcaaggacgccacccccuccgcggacggcgccaacggggccggccagcuggugccggaggucaacaacgccgagccccucccccuggaccccguggccggggcgagcaccgcccuggccacggccggccaggugaacaugaucgacccguggaucuucaacaacuucguccaggcgccccagggggaguucaccaucucccccaacaacacccccggcgacauccucuucgaccugcagcugggcccgcaccucaaccccuuccuggcccaccugagccagauguacaacgggugggugggcaacaugcgcgugcgggucauccucgccgggaacgccuucaccgccggcaaggugaucaucugcugcgugccgcccggguuccagucccgcacgcugagcaucgcgcaggccacccuguucccccacaucaucgccgacguccggacccucgagcccaucgagaucccccuggaggacgugcgcaacacccuguaccacacgaacgacaaccagcccaccaugcggcuccugugcaugcuguacaccccgcuccgcaccggcggcggguccggcgggacggacgccuucguggucgccggccgggugcugaccagccccucccccgacuucaacuuccuguuccucgugcccccgaccgucgagcagaagacccgccccuucagcgugcccaacaucccccugcagcugcucuccaacagccgggugccgaaccugauccaguccaugguccugagccccgaccaggcgcagaacgugcaguuccagaacggccgcugcacgaccgacgggcagcuccugggcaccacccccguguccgucagccagauccugaaguuccgggggaagguguccgccggcagcaaggugaucaaccucacggagcuggacgggucccccuuccuggccuucgaggccccggcccccaccggcuuccccgaccucggcaccagcgacuggcacaucgagaugagccugaacuccaacagccaguccagcgggaacccgauccugcuccgcgacauccagcccaacuccagcgacuucgucccccaccugggcuccguggcggucaccacggccaucgacaccgccggggacuacaccggcaccauccaguggacgagccagcccuccaacgugaccccggugcccgacgucaacuucuggaccaucccccaguacgggagcaaccuggccgaggccucccagcucgcgcccgugguguacccgcccggcuucggcgaggccaucgucuacuucaugagccccauccccgggccgaacaccgcccacaagcccaaccuggugcccugccugcucccccaggaguucgugacgcacuucgucuccgagcaggccccgagcaugggcgaggcggcccuggugcacuacguggaccccgacaccaaccggaaccugggggaguucaagcucuaccccgagggcuucaucacgugcguccccaacgggaccggcccgcagcagcugccccugaacggcguguucguguucgccuccugggucagccgcuucuaccagcucaagcccguggggaccgccaacuccgcccgguga

SEQ ID NO: 12836 - RNA, 1611 nt, Artificial Sequence
  derived and/or modified sequence opt1 from VP1__Norovirus_and/or_Norovirus-like__KT732277
augaugauggccagcaaggacgccacccccuccgcggacggcgccaacggggccggccagcuggugccggaggucaacaacgccgagccccucccccuggaccccguggccggggcgagcaccgcccuggccacggccggccaggugaacaugaucgacccguggaucuucaacaacuucguccaggcgccccagggggaguucaccaucucccccaacaacacccccggcgacauccucuucgaccugcagcugggcccgcaccucaaccccuuccuggcccaccugagccagauguacaacgggugggugggcaacaugcgcgugcgggucauccucgccgggaacgccuucaccgccggcaaggugaucaucugcugcgugccgcccggguuccagucccgcacgcugagcaucgcgcaggccacccuguucccccacaucaucgccgacguccggacccucgagcccaucgagaucccccuggaggacgugcgcaacacccuguaccacacgaacgacaaccagcccaccaugcggcuccugugcaugcuguacaccccgcuccgcaccggcggcggguccggcgggacggacgccuucguggucgccggccgggugcugaccagccccucccccgacuucaacuuccuguuccucgugcccccgaccgucgagcagaagacccgccccuucagcgugcccaacaucccccugcagcugcucuccaacagccgggugccgaaccugauccaguccaugguccccagccccgaccaggcgcagaacgugcaguuccagaacggccgcugcacgaccgacgggcagcugcucggcaccacccccguguccgucagccagauccugaaguuccgggggaagguguccgccggcagcaaggugaucaaccugacggagcucgacggguccccguuccuggccuucgaggcccccgcccccaccggcuucccggaccugggcaccagcgacuggcacaucgagaugagccucaacuccaacagccaguccagcgggaaccccauccugcugcgcgacauccagcccaacuccagcgacuucgucccccaccucggcuccguggcggucaccacggccaucgacaccgccggggacuacaccggcaccauccaguggacgagccagccguccaacgugacccccgugcccgacgucaacuucuggaccaucccccaguacgggagcaaccuggccgaggccucccagcuggcgccggugguguacccgcccggcuucggcgaggccaucgucuacuucaugagccccauccccgggcccaacaccgcccacaagcccaaccucgugcccugccugcugccgcaggaguucgugacgcacuucgucuccgagcaggcccccagcaugggcgaggcggcccucgugcacuacguggaccccgacaccaaccggaaccugggggaguucaagcuguaccccgagggcuucaucacgugcgucccgaacgggaccggcccccagcagcucccccugaacggcguguucguguucgccuccugggucagccgcuucuaccagcugaagcccguggggaccgccaacuccgcccgguga

SEQ ID NO: 12837 - RNA, 1611 nt, Artificial Sequence
  derived and/or modified sequence opt1 from VP1__Norovirus_and/or_Norovirus-like__KJ402295
augaugauggccagcaaggacgcccccuccagcgcggacggcgccaacggggccggccagcuggugccggaggucaacaacgccgagccccucccccuggaccccguggccggggcguccaccgcccuggccaccgccggccaggugaacaugaucgacccguggaucuucaacaacuucguccaggcgccccagggggaguucacgaucagccccaacaacacccccggcgacauccucuucgaccugcagcugggcccgcaccucaaccccuuccuggcccaccugucccagauguacaacgggugggugggcaacaugcgcgugcgggucauccucgccgggaacgccuucaccgccggcaaggugaucaucugcugcgugccgcccggguuccagagccgcacccuguccaucgcgcaggccacgcuguucccccacaucaucgccgacguccggacccucgagcccaucgagaucccccuggaggacgugcgcaacacccuguaccacaccaacgacaaccagcccacgaugcggcuccugugcaugcuguacaccccgcuccgcaccggcggcgggagcggcgggaccgacgccuucguggucgccggccgggugcugacgugccccuccagcgacuucaacuuccuguuccucgugccgcccaccgucgagcagaagacccgccccuucuccgugcccaacaucccccugcagcugcucagcaacucccgggugcccaaccugauccagagcaugguccuguccccggaccaggcgcagaacgugcaguuccagaacggccgcugcaccacggacgggcagcuccugggcaccacccccgugagcgucucccagauccugaaguuccgggggaaggugagcgccggcuccaaggugaucaaccucaccgagcuggacgggagccccuuccuggccuucgaggcccccgccccgacgggcuuccccgaccucggcaccagcgacuggcacgucgagaugucccugaacagcaacucccagagcuccgggaaccccauccugcuccgcgacauccacccgaacagcuccgaguucgugccccaccugggcagcgucugcgugaccgcggccaucgagguggccggggacuacaccggcacgauccaguggaccucccagcccagcaacgucacccccgugccggacgugaacuucuggaccaucccccacuacggguccaaccuggccgaggccagccagcucgcgcccgucguguacccgcccggcuucggcgaggccaucguguacuucaugucccccauccccgggcccaacacggcccacaagccgaaccugguccccugccugcucccccaggaguucgugacccacuucgugagcgagcaggcccccuccaugggcgaggcggcccugguccacuacguggacccggacaccaaccggaaccugggggaguucaagcucuaccccgagggcuucaucacgugcgugcccaacgggaccggcccccagcagcugccgcugaacggcgucuucguguucgccagcugggugucccgcuucuaccagcucaagcccgucgggaccgccagcuccgcccgguga

SEQ ID NO: 12838 - RNA, 1611 nt, Artificial Sequence
  derived and/or modified sequence opt1 from VP1__Norovirus_and/or_Norovirus-like__AF414406
augaugauggccagcaaggacgccucccccagcgcggacggcgccaacggggccggccagcuggugccggaggucaacaacgccgagccccucccccuggaccccguggccggggcguccaccgcccuggccaccgccggccaggugaacaugaucgacccguggaucuucaacaacuucguccaggcgccccagggggaguucacgaucagccccaacaacacccccggcgacauccucuucgaccugcagcugggcccgcaccucaaccccuuccuggcccaccugucccagauguacaacgggugggugggcaacaugcgcgugcgggucauccucgccgggaacgccuucaccgccggcaaggugaucgugugcugcgucccgcccggguuccagagccgcacccuguccaucgcgcaggccacgcuguucccccacaucaucgccgacgugcggacccucgagcccaucgagaucccccuggaggacgugcgcaacacccuguaccacaccaacgacaaccagcccacgaugcggcuccugugcaugcuguacaccccgcuccgcaccggcggcgggagcggcgggaccgacgccuucgucguggccggccgggugcugacgugccccuccagcgacuucaacuuccuguuccucgucccgcccaccguggagcagaagacccgccccuucuccgugcccaacaucccccugcagcugcucagcaacucccggguccccaaccugauccagagcauggugccgucccccgaccaggcgcagaacgugcaguuccagaacggccgcugcaccacggacgggcagcugcucggcaccacccccgucagcgugucccagauccugaaguuccgggggaaggugagcgccggcucccgcgucaucaaccugaccgagcucgacgggagccccuuccuggccuucgaggccccggcccccacgggcuuccccgaccugggcaccagcgacuggcacguggagaugucccucaacagcaacucccagagcuccgggaacccgauccugcugcgggacauccagcccaacagcuccgacuucgucccccaccucggcagcguggcggugaccaccgccaucgacgucgccggggacuacacgggcaccauccaguggaccucccagcccagcaacgugaccccggugcccgacgucaacuucuggacgaucccccaguacggguccaaccuggccgaggccagccagcuggcgcccgugguguacccgcccggcuucggcgaggccaucgucuacuucaugucccccauccccgggccgaacaccgcccacaagcccaaccucgugccccgccugcugccccaggaguucgugacccacuucgucagcgagcaggccccguccaugggcgaggcggcccucgugcacuacguggaccccgacaccaaccggaaccugggggaguucaagcuguaccccgagggcuucgucacgugcaugcccaacgggaccggcccgcagcagcucccccugaacggcguguucguguucgccagcugggucucccgcuucuaccagcugaagcccguggggaccgccagcuccgcccgguga

SEQ ID NO: 12839 - RNA, 1611 nt, Artificial Sequence
  derived and/or modified sequence opt1 from VP1__Norovirus_and/or_Norovirus-like__AB039774
augaugauggccagcaaggacgccacccccuccgcggacggcgccaacggggccggccagcuggugccggaggucaacaacgccgagccccucccccuggaccccguggccggggcgagcaccgcccuggccacggccggccaggugaacaugaucgacccguggaucuucaacaacuucguccaggcgccccagggggaguucaccaucucccccaacaacacccccggcgacauccucuucgaccugcagcugggcccgcaccucaaccccuuccuggcccaccugagccagauguacaacgggugggugggcaacaugcgcgugcgggucauccucgccgggaacgccuucaccgccggcaaggugaucaucugcugcgugccgcccggguuccagucccgcacgcugagcaucgcgcaggccacccuguucccccacgucaucgccgacgugcggacccucgagccccuggagaucccccuggaggacgugcgcaacacccucuaccacaacaacgacucccagcccacgaugcggcugcugugcaugcucuacaccccgcugcgcaccggcggcgggagcggcgggaccgacgccuucgucguggccggccgggugcugacgugccccucccccgacuucaacuuccucuuccuggugcccccgaccgucgagcagaagacccgccccuucagcgugcccaacaucccccugcagaaccucuccaacagccgggucccgucccugauccagagcauggugcuguccaacgaccacgcgcagaccgugcaguuccagaacggccgcugcacgaccgacgggcaccuccugggcaccacccccgucagcgccgggcagcugaugaaguuccggggcaaggugacguccgggagcaaggugcucaaccugaccgagcuggacggcucccccuuccucgccuucgaggcccccgccccggcgggcuuccccgaccuggggaagugcgacuggcacgucgagaugagccuguaccaggacaacaaccacgccgaccccaucgugcuccacgccaucgagccgaacagcuccagcuucgucccccaccugggcuccgugagcuucaaggagaacgugaacgucgccggggacuacgugugcaccauccaguacaccuccccgcccagcgacccccacaaccccaacgccgacguggacuucugguccauccccgacuacggcagcaaccuggcggaggccucccagcucgcccccgucguguacccgcccggguucggcgaggccaucguguacuucaugagccgcguccccggcuggaaccggacgaaccgccugaaccuggugcccugccuccugccgcaggaguucaucgggcacuucguguccgagcaggcgcccgccaucggcgaggccgcccugcuccacuacgucgaccccgacaccaaccggaaccugggggaguucaagcuguaccccgagggcuucaucacgugcgugccgaacgggaccggcccccagcagcucccccugaacggcguguucgucuucagcuccugggugagccgcuucuaccagcugaagcccguggggaccgccucccuggcgcgguga

SEQ ID NO: 12840 - RNA, 1611 nt, Artificial Sequence
  derived and/or modified sequence opt1 from VP1__Norovirus_and/or_Norovirus-like__KP064095
auggccagcaaggacgcgccccaguccgccgacggcgccagcggggccggccagcuggugccggaggucaacaccgccgacccccuccccauggagcccguggccgggccgaccacggcgguggccaccgccggccaggucaacaugaucgaccccuggaucgugaacaacuucgugcagagcccccagggggaguucaccaucucccccaacaacaccccgggcgacauccuguucgaccugcagcucggcccccaccugaaccccuuccugucccaccucagccagauguacaacgggugggucggcaacaugcgcgugcggauccugcuggccgggaacgcguucuccgccggcaagaucaucgugugcugcgugcccccgggguucacgagcuccagccucaccaucgcccaggccacccuguucccccacgucaucgccgacgugcgcacccuggagcccaucgagaugccccucgaggacguccggaacgugcuguaccacacgaacgacaaccagccgaccaugcgccuggugugcaugcucuacacgccccugcggaccggcggcggguccggcaacagcgacuccuucgucguggcggggcgcgugcugaccgcccccagcuccgacuucagcuuccucuuccuggugcccccgaccaucgagcagaagacccgggccuucaccguccccaacaucccccugcagacgcucuccaacagccgcuuccccucccugauccagggcaugauccugagcccggacgccagccaggugguccaguuccagaacggccggugccucaucgacgggcagcugcugggcaccacccccgccaccuccgggcagcuguuccgcgugcggggcaagaucaaccagggggcgcgcacgcucaaccugaccgagguggacggcaagcccuucauggccuucgacagccccgccccggucggcuuccccgacuucgggaagugcgacuggcacaugcggaucuccaagacccccaacaacaccagcuccggcgacccgaugcgcagcguguccguccagacgaacgugcagggguucgugccccaccucggcagcauccaguucgacgaggucuucaaccaccccaccggggacuacaucggcaccaucgaguggaucucccagcccagcaccccgcccggcacggacaucaaccugugggagauccccgacuacggguccagccugucccaggccgccaaccucgcgcccccgguguucccgcccggcuucggggaggcccugguguacuucgucagcgccuuccccggccccaacaaccgguccgcccccaacgacgugcccugccugcucccccaggaguacaucacccacuucgugagcgagcaggccccgaccaugggggacgcggcccugcugcacuacgucgaccccgacaccaaccgcaaccucggcgaguucaagcuguaccccggcggguaccugacgugcgugcccaacggcgugggggccggcccgcagcagcucccccugaacggcgucuuccuguucguguccugggugagccgguucuaccagcucaagcccgucgggaccgccuccaccgcgcgcuga

SEQ ID NO: 12841 - RNA, 1608 nt, Artificial Sequence
  derived and/or modified sequence opt1 from VP1__Norovirus_and/or_Norovirus-like__AB045603
augaagauggccagcuccgacgccgcgcccagcaacgacggcgccgccgggcuggugccggaggccaacaacgagaccauggcccucgagcccgucgcgggcgccuccaucgccgcgccccugaccgggcagaacaacaucaucgaccccuggauccgccugaacuucgugcaggccccgaacggcgaguucacggugagcccccggaacucccccggggagguccuccugaaccuggagcucggccccgagcugaacccguaccuggcccaccucagccgcauguacaacggcuacgccgggggcguggaggugcagguccugcuggccgggaacgccuucaccgcgggcaagcucguguucgccgccgugccgccccacuucccccuggagaacaucucccccgggcagaucaccauguucccccacgucaucaucgacgugcggacccuggagcccgugcuccugccccugccggacguccgcaacaacuucuuccacuacaaccagcagaacgagccccggaugcgccucguggccaugcuguacacgccccugcggagcaacggcuccggcgacgacguguucaccgucagcugccgcgugcucacccggcccuccccggacuucgacuucaacuaccuggugccgcccaccgucgagagcaagacgaagcccuucacccugcccauccucaccaucggggagcugaccaacucccgcuuccccgugcccaucgacgagcuguacacgagccccaacgagucccucgugguccagccgcagaacggccggugcgcccuggacggggagcugcagggcaccacccagcuccugcccaccgcgaucugcagcuuccgcggccggaucaaccagaagguguccggggagaaccacguguggaacaugcaggucacgaacaucaacggcacccccuucgacccgaccgaggacgugcccgcgccccuggggacccccgacuucagcggcaagcuguucgggguccucucccagcgcgaccacgacaacgccugccggagccacgacgccgugaucgccacgaacagcgccaaguucaccccgaagcugggcgccauccagaucggcaccugggaggaggacgacgugcacaucaaccagcccaccaaguucacgcccgucggccucuucgagaacgagggguucaaccaguggacccugcccaacuacuccggggcccugacccucaacaugggccuggccccgcccguggcccccaccuuccccggggagcagauccuguucuuccgcagccacaucccgcucaagggcggcguggcggaccccgucaucgacugccugcugccccaggaguggauccagcaccucuaccaggaguccgcccccagccaguccgacguggcccugauccgguucacgaacccggacaccgggcgcgugcuguucgaggccaagcuccaccggagcggcuacaucaccgucgcgaacaccgggucccgccccaucguggugcccgccaacggcuacuuccgguucgacagcugggucaaccaguucuacucccuggcccccauggggacgggcaacggccgccgccgggugcaguga

SEQ ID NO: 12842 - RNA, 1608 nt, Artificial Sequence
  derived and/or modified sequence opt1 from VP1__Norovirus_and/or_Norovirus-like__AF397905
augaagauggccagcuccgacgccgcgcccagcaacgacggcgccgccgggcuggugccggaggccaacaacgagaccauggcccucgagcccgucgcgggcgccuccaucgccgcgccccugaccgggcagaacaacaucaucgaccccuggauccgccugaacuucgugcaggccccgaacggcgaguucacggugagcccccggaacucccccggggagguccuccugaaccuggagcucggccccgagcugaacccguaccuggcccaccucagccgcauguacaacggcuacgccgggggcguggaggugcagguccugcuggccgggaacgccuucaccgcgggcaagcucguguucgccgccgugccgccccacuucccccuggagaacaucucccccgggcagaucaccauguucccccacgucaucaucgacgugcggacccuggagcccgugcuccugccccugccggacguccgcaacaacuucuuccacuacaaccagcagaacgagccccggaugcgccucguggccaugcuguacacgccccugcggagcaacggcuccggcgacgacguguucaccgucagcugccgcgugcucacccggcccuccccggacuucgacuucaacuaccuggugccgcccaccgucgagagcaagacgaagcccuucacccugcccauccucaccaucggggagcugaccaacucccgcuuccccgugcccaucgacgagcuguacacgagccccaacgagucccucgugguccagccgcagaacggccggugcgcccuggacggggagcugcagggcaccacccagcuccugcccaccgcgaucugcagcuuccgcggccggaucaaccagaagguguccggggagaaccacguguggaacaugcaggucacgaacaucaacggcacccccuucgacccgaccgaggacgugcccgcgccccuggggacccccgacuucagcggcaagcuguucgggguccucucccagcgcgaccacgacaacgccugccggagccacgacgccgugaucgccacgaacagcgccaaguucaccccgaagcugggcgccauccagaucggcaccugggagcaggacgacgugcacaucaaccagcccaccaaguucacgcccgucggccucuucgagaacgagggguucaaccaguggacccugcccaacuacuccggggcccugacccucaacaugggccuggccccgcccguggcccccaccuuccccggggagcagauccuguucuuccgcagccacaucccgcucaagggcggcguggcggaccccgucaucgacugccugcugccccaggaguggauccagcaccucuaccaggaguccgcccccagccaguccgacguggcccugauccgguucacgaacccggacaccgggcgcgugcuguucgaggccaagcuccaccggagcggcuacaucaccgucgcgaacaccgggucccgccccaucguggugcccgccaacggcuacuuccgguucgacagcugggucaaccaguucuacucccuggcccccauggggacgggcaacggccgccgccgggugcaguga

SEQ ID NO: 12843 - RNA, 1608 nt, Artificial Sequence
  derived and/or modified sequence opt1 from VP1__Norovirus_and/or_Norovirus-like__AF414420
augaagauggccagcuccgacgccgcgcccagcaacgacggcgccgccgggcuggugccggaggccaacaacgagaccauggcccucgagcccgucgcgggcgccuccaucgccgcgccccugaccgggcagaacaacaucaucgaccccuggauccgccugaacuucgugcaggccccgaacggcgaguucacggugagcccccggaacucccccggggagguccuccugaaccuggagcucggccccgagcugaacccguaccuggcccaccucagccgcauguacaacggcuacgccgggggcguggaggugcagguccugcuggccgggaacgccuucaccgcgggcaagcucguguucgccgccgugccgccccacuucccccuggagaacaucucccccgggcagaucgccauguucccccacgucaucaucgacgugcggacccuggagcccgugcuccugccccugccggacguccgcaacaacuucuuccacuacaaccagcagaacgagccccggaugcgccucguggccaugcuguacacgccccugcggagcaacggcuccggcgacgacguguucaccgucagcugccgcgugcucacccggcccuccccggacuucgacuucaacuaccuggugccgcccaccgucgagagcaagaccaagcccuucacgcugcccauccucaccaucggggagcugaccaacucccgcuuccccgugcccaucgacgagcuguacaccagccccaacgagucccucgugguccagccgcagaacggccggugcgugcuggacggggagcugcagggcacgacccagcuccugcccaccgcgaucugcagcuuccgcggccggaucaaccagaagguguccggggagaaccacgucuggaacaugcaggucaccaacaucaacggcacgcccuucgacccgaccgaggacgugcccgcgccccuggggacccccgacuucagcggcaagcuguucggggugcucucccagcgcgaccacgacaacgccugccggagccacgacgccgugaucgccaccaacagcgccaaguucacgccgaagcugggcgccauccagaucggcaccugggaggaggacgacguccacaucaaccagcccaccaaguucacccccgugggccucuucgagaacgagggguucaaccaguggacgcugcccaacuacuccggggcccugacccucaacaugggccuggccccgcccguggcccccaccuuccccggggagcagauccuguucuuccgcagccacaucccgcucaagggcggcgucgcggaccccgugaucgacugccugcugccccaggaguggauccagcaccucuaccaggaguccgcccccagccaguccgacguggcccugauccgguucaccaacccggacacggggcgcguccuguucgaggccaagcuccaccggagcggcuacaucaccguggcgaacaccgggucccgccccaucgugguccccgccaacggcuacuuccgguucgacagcugggugaaccaguucuacucccuggcccccauggggaccggcaacggccgccgccgggugcaguga

SEQ ID NO: 12844 - RNA, 1608 nt, Artificial Sequence
  derived and/or modified sequence opt1 from VP1__Norovirus_and/or_Norovirus-like__AF427119
augaagauggccagcuccgacgccgcgcccagcaacgacggcgccgccgggcuggugccggaggccaacaacgagaccauggcccucgagcccgucgcgggcgccuccaucgccgcgccccugaccgggcagaacaacgugaucgaccccuggauccgccugaacuucgugcaggccccgaacggcgaguucacggucagcccccggaacucccccggggagauccuccugaaccuggagcucggccccgagcugaacccguaccuggcccaccucagccgcauguacaacggcuacgccgggggcguggaggugcagguccugcuggccgggaacgccuucaccgcgggcaagcucguguucgccgccgugccgccccacuucccccuggagaacaucucccccgggcagaucaccauguucccccacgucaucaucgacgugcggacccuggagcccgugcuccugccccugccggacguccgcaacagcuucuuccacuacaaccagcagaacgagccccggaugcgccucguggccaugcuguacacgccccugcgguccaacggcagcggcgacgacguguucaccgucuccugccgcgugcucacccggcccagcccggacuucgacuucaacuaccuggugccgcccaccgucgaguccaagacgaagcccuucacccugcccauccucaccaucggggagcugaccaacagccgcuuccccgcccccaucgacgagcuguacacgucccccaacgagagccucguggugcagccgcagaacggccggugcgcgcuggacggggagcugcagggcaccacccagcuccugcccaccgccaucugcuccuuccgcggccggaucaaccagaaggucagcggggagaaccacaucuggaacaugcaggucacgaacaccaacggcacccccuucgacccgaccgaggacgugcccgcgccccuggggacgcccgacuucuccggccgccucuucggggugcugagccagcgggaccacgacaacgccugccgcagccacgacgccgugaucgccaccaacuccgccaaguucaccccgaagcugggcgccauccagaucggcaccugggaggaggacgacguccacaucaaccagcccacgaaguucacccccgugggccucuucgagcacggggacuucaaccaguggacccugcccaacuacagcggggcccugacccucaacaugggccuggccccgcccguggcgcccacguuccccggggagcagauccuguucuuccggucccacaucccgcucaagggcggcgucgccgaccccgugaucgacugccugcugccccaggaguggauccagcaccucuaccaggagagcgcccccucccagagcgacguggcccugauccgcuucaccaacccggacaccgggcggguccuguucgaggcgaagcuccaccgcuccggcuacaucaccguggccaacacggggagccggcccaucgugguccccgccaacggcuacuuccgcuucgacuccugggugaaccaguucuacagccuggcccccauggggaccggcaacggccgccggcgcgugcaguga

SEQ ID NO: 12845 - RNA, 1608 nt, Artificial Sequence
  derived and/or modified sequence opt1 from VP1__Norovirus_and/or_Norovirus-like__AB044366
augaagauggccagcuccgacgccgcgcccagcaacgacggcgccgccgggcuggugccggaggccaacaacgagaccauggcccucgagcccgucgcgggcgccuccaucgccgcgccccugaccgggcagaacaacaucaucgaccccuggauccgccugaacuucgugcaggccccgaacggcgaguucacggugagcccccggaacucccccggggagguccuccugaaccuggagcucggccccgagcugaacccguaccuggcccaccucagccgcauguacaacggcuacgccgggggcguggaggugcagguccugcuggccgggaacgccuucaccgcgggcaagcucguguucgccgccgugccgccccacuucccccuggagaacaucucccccgggcagaucaccauguucccccacgucaucaucgacgugcggacccuggagcccgugcuccugccccugccggacguccgcaacaacuucuuccacuacaaccagcagaacgagccccggaugcgccucguggccaugcuguacacgccccugcggagcaacggcuccggcgacgacguguucaccgucagcugccgcgugcucacccggcccuccccggacuucgacuucaacuaccuggugccgcccaccgucgagagcaagacgaagcccuucacccugcccauccucaccaucggggagcugaccaacucccgcuuccccgugcccaucgacgagcuguacacgagccccaacgagucccucgugguccagccgcagaacggccggugcgcccuggacggggagcugcagggcaccacccagcuccugcccaccgcgaucugcagcuuccgcggccggaucaaccagaagguguccggggagaaccacguguggaacaugcaggucacgaacaucaacggcacccccuucgacccgaccgaggacgugcccgcgccccuggggacccccgacuucagcggcaagcuguucgggguccucucccagcgcgaccacgacaacgccugccggagccacgacgccgugaucgccacgaacagcgccaaguucaccccgaagcugggcgccauccagaucggcaccugggaggaggacgacgugcacaucaaccagcccaccaaguucacgcccgucgggcuguucgaggacggcggguucaaccaguggacccuccccaacuacuccggcgcccugacccucaacauggggcuggccccgcccguggcccccaccuuccccggcgagcagauccuguucuuccgcagccacaucccgcucaagggcgggguggcggaccccgucaucgacugccugcugccccaggaguggauccagcaccucuaccaggaguccgcccccagccaguccgacguggcccugauccgguucacgaacccggacaccggccgcgugcuguucgaggccaagcuccaccggagcggguacaucaccgucgcgaacaccggcucccgccccaucguggugcccgccaacggguacuuccgguucgacagcugggucaaccaguucuacucccuggcccccaugggcacgggcaacgggcgccgccgggugcaguga

SEQ ID NO: 12846 - RNA, 1608 nt, Artificial Sequence
  derived and/or modified sequence opt1 from VP1__Norovirus_and/or_Norovirus-like__AB032758
augaagauggccagcaacgacgccgcgcccuccaacgacggcgccgccgggcuggugccggaggccaacaacgagaccauggcccucgagcccgucgcgggcgccagcaucgccgcgccccugaccgggcagaacaacaucaucgaccccuggauccgccugaacuucgugcaggccccgaacggcgaguucacggugagcccccggaacucccccggggagguccuccugaaccuggagcucggccccgagcugaacccguaccuggcccaccucucccgcauguacaacggcuacgccgggggcguggaggugcagguccugcuggccgggaacgccuucaccgcgggcaagcucguguucgccgccgugccgccccacuucccccuggagaacaucagccccgggcagaucaccauguucccccacgucaucaucgacgugcggacccuggagcccgugcuccugccccugccggacguccgcaacaacuucuuccacuacaaccagcagaacgagccccggaugcgccucguggccaugcuguacacgccccugcgguccaacggcagcggcgacgacguguucaccgucuccugccgcgugcucacccggcccagcccggacuucgacuucaacuaccuggugccgcccacccuggaguccaagacgaagcccuucacccuccccauccugaccaucggggagcugaccaacagccgcuuccccguccccaucgacgagcucuacacgucccccaacgagagccugguggugcagccgcagaacggccggugcgcccuggacggggagcuccagggcaccacccagcugcugcccaccgcgaucugcuccuuccgcggccggaucaaccagaaggucagcggggagaaccacguguggaacaugcaggucacgaacaucaacggcacccccuucgacccgaccggggacgugcccgcgccccucggcacccccgacuucuccgggaagcuguucggcgugcugagccagcgcgaccacgacaacgccugccggucccacgacgccgucaucgccacgaacagcgccaaguucaccccgaagcucggcgccauccagaucgggaccugggaggaggacgacgugcacaucaaccagcccaccaaguucacgcccgugggccuguucgagaacgagggguucaaccaguggacccugcccaacuacagcggcgcccucacccugaacauggggcuggccccgcccgucgcccccaccuuccccggcgagcagauccucuucuuccgcucccacaucccgcugaagggcgggguggcggaccccgugaucgacugccugcucccccaggaguggauccagcaccuguaccaggagagcgcccccucccagagcgacgucgcccugauccgguucacgaacccggacaccggccgcguccucuucgaggccaagcugcaccgguccggguacaucaccguggcgaacaccggcagccgccccaucguggugcccgccaacggguacuuccgguucgacacgugggugaaccaguucuacucccuggcccccaugggcaccggcaacgggcgccgccggguccaguga

SEQ ID NO: 12847 - RNA, 1608 nt, Artificial Sequence
  derived and/or modified sequence opt1 from VP1__Norovirus_and/or_Norovirus-like__AB039775
augaagauggccagcuccgacgccgcgcccagcaacgacggcgccgccgggcuggugccggaggccaacaacgagaccauggcccucgagcccgucgcgggcgccuccaucgccgcgccccugaccgggcagaacaacaucaucgaccccuggauccgccugaacuucgugcaggccccgaacggcgaguucacggugagcccccggaacucccccggggagguccuccugaaccuggagcucggccccgagcugaacccguaccuggcccaccucagccgcauguacaacggcuacgccgggggcguggaggugcagguccugcuggccgggaacgccuucaccgcgggcaagcucguguucgccgccgugccgccccacuucccccuggagaacaucucccccgggcagaucaccauguucccccacgucaucaucgacgugcggacccuggagcccgugcuccugccccugccggacguccgcaacaacuucuuccacuacaaccagcagaacgagccccggaugcgccucguggccaugcuguacacgccccugcggagcaacggcuccggcgacgacguguucaccgucagcugccgcgugcucacccggcccuccccggacuucgacuucaacuaccuggugccgcccaccgucgagagcaagacgaagcccuucacccugcccacccucaccaucggggagcugacgaacucccgcuuccccgugcccaucgacgagcuguacaccagccccaacgagucccucgugguccagccgcagaacggccggugcgcccuggacggggagcugcgcggcaccacccagcuccugcccacggcgaucugccccuuccggggccgcaucaaccagaaggugagcggggagaaccacguguggaacaugcaggucaccaacaucaacggcaccccguucgaccccaccgaggacgugcccgcgccccuggggacgccggacuucuccggcaagcuguucgggguccucagccagcgggaccacgacaacgccugccgcucccacgacgccgugaucgccaccaacagcgccaaguucacccccaagcugggcgccauccagaucggcaccugggaggaggacgacgugcacaucaaccagcccacgaaguucacccccgucggccucuucgagaacgagggguucaaccaguggacccugccgaacuacagcggggcccugacccucaacaugggccuggccccgcccguggcccccacguuccccggggagcggauccuguucuuccgcucccacaucccccucaagggcggcguggcggaccccgucaucgacugccugcugcaccaggaguggauccagcaccucuaccaggagagcgcccccucccagagcgacguggcccugauccgguucaccaacccggacaccgggcgcgugcuguucgaggccaagcuccaccgguccggcuacaucaccgucgcgaacacggggagccgccccaucguggugcccgccaacggcuacuuccgcuucgacuccugggucaaccaguucuacagccuggcccccauggggaccggcaacggccggcgccgggugcaguga

SEQ ID NO: 12848 - RNA, 1608 nt, Artificial Sequence
  derived and/or modified sequence opt1 from VP1__Norovirus_and/or_Norovirus-like__AF414418
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggagauccugcucaaccuggagcugggccccggccucaacccguuccuggcccaccugucccgcauguacaacggguacgccggcgggguggagguccaggugcuccuggccggcaacgccuucaccgccgggaagcugguguucgcggccaucccgccccacuuccccaucgagaaccucagccccggccagaucaccauguucccccacgucaucaucgacgugcggacccuggagcccgugcugcucccccugccggacguccgcaacaacuucuuccacuacaaccaggagcccgagccccggaugcgccugguggccaugcucuacacgccccugcgguccaacggcagcggggacgacguguucaccgucuccugccgcgugcugacccggccgagccccgacuucgacuucaacuaccucgugccgcccaccgucgaguccaagacgaagcccuucacccugcccauccugaccaucggcgagcucagcaacucccgcuuccccgcccccaucgacgagcuguacaccagcccgaacgaggggcugguggugcagccccagaacggccgguccacgcucgacggcgagcugcuggggaccacccagcucguccccagcaacaucugcucccugcgcggccggaucaacgcccaccugagcgacaaccagcaccgcuggaacaugcaggucaccaacgcgaacgggacgccguucgaccccaccgaggacgugcccgcgccccucggcaccccggacuuccuggccaacaucuacggggugaccucccagcggaaccccgacaacacgugccgcgcccacgacggcauccuggccaccuggagccccaaguucacccccaagcucggcagcgugguccuggggaccugggaggaccgggacuucgacaucaaccagccgacgcgcuucacccccgugggccuguacgacaccgaccacuucaaccagugggcccuccccaacuacuccggggcccugacccugaacaugaaccucgcccccagcguggccccgcuguuccccggcgagcagcuccuguucuuccggucccacaucccccugaagggcgggacgagcaacggcgccaucgacugccugcucccccaggaguggguccagcacuucuaccaggaguccgcgccgagcuccaccgacguggcccugauccgcuacaccaaccccgacaccgggcgggugcuguucgaggccaagcugcaccgccagggcuucaucacggucgccaacagcgggucccgccccaucguggugcccccgaacggcuacuuccgguucgacagcugggucaaccaguucuacucccucgcgcccauggggaccggcaacggccgccggcgcgugcaguga

SEQ ID NO: 12849 - RNA, 1608 nt, Artificial Sequence
  derived and/or modified sequence opt1 from VP1__Norovirus_and/or_Norovirus-like__AF425769
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggagauccugcucaaccuggagcugggccccgagcucaacccguuccuggcccaccugucccgcauguacaacggcuacgccgggggcguggagguccaggugcuccuggccgggaacgccuucaccgccggcaagcugguguucgcggccaucccgccccacuuccccaucgagaaccucagccccgggcagaucaccauguucccccacgucaucaucgacgugcggacccuggagcccgugcugcucccccugccggacguccgcaacaacuucuuccacuacaaccaggagcccgagccccggaugcgccugguggccaugcucuacacgccccugcgguccaacggcagcggcgacgacguguucaccgucuccugccgcgugcugacccggccgagccccgacuucgacuucaacuaccucgugccgcccaccgucgaguccaagacgaagcccuucacccugcccauccugaccaucggggagcucagcaacucccgcuuccccgcccccaucgacgagcuguacaccagcccgaacgagggccugguggugcagccccagaacgggcgguccacgcucgacggcgagcugcugggcaccacccagcucguccccagcaacaucugcucccugcgcgggcggaucaacgcccaccugagcgacaaccagcaccgcuggaacaugcaggucaccaacgugaacggcacgccguucgaccccaccgaggacgugcccgcgccccucgggaccccggacuuccuggccaacaucuacggcgugaccucccagcggaaccccgacaacacgugccgcgcccacgacgggauccuggccaccuggagccccaaguucacccccaagcucggcagcgucgugcugggcaccugggaggaccgggacuucgacaucaaccagccgacgcgcuucacccccguggggcuguacgacaccgaccacuucaaccagugggcccuccccaacuacuccggcgcgcugacccugaacaugaaccucgcccccagcgucgccccgcuguuccccggggagcagcuccuguucuuccggucccacaucccccugaagggcgggacgagcaacggcgccaucgacugccugcucccccaggagugggugcagcacuucuaccaggaguccgccccgagcuccaccgacguggcgcugauccgcuacaccaaccccgacaccggccggguccuguucgaggccgagcugcaccgccagggguucaucacgguggccaaccccggcagccgccccaucguggucccgcccaacggguacuuccgguucgacuccugggugaaccaguucuacagccucgcccccaugggcaccgggaacggccgccggcgcgugcaguga

SEQ ID NO: 12850 - RNA, 1608 nt, Artificial Sequence
  derived and/or modified sequence opt1 from VP1__Norovirus_and/or_Norovirus-like__AF414421
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggagauccugcucaaccuggagcugggccccgagcucaacccguuccuggcccaccugucccgcauguacaacggcuacgccgggggcguggagguccaggugcuccuggccgggaacgccuucaccgccggcaagcugguguucgcggccaucccgccccacuuccccaucgagaaccucagccccgggcagaucaccauguucccccacgucaucaucgacgugcggacccuggagcccgugcugcucccccugccggacguccgcaacaacuucuuccacuacaaccaggagcccgagccccggaugcgccugguggccaugcucuacacgccccugcgguccaacggcagcggcgacgacguguucaccgucuccugccgcgugcugacccggccgagccccgacuucgacuucaacuaccucgugccgcccaccgucgaguccaagacgaagcccuucacccugcccauccugaccaucggggagcucagcaacucccgcuuccccgcccccaucgacgagcuguacaccagcccgaacgagggccugguggugcagccccagaacgggcggcccacgcucgacggcgagcugcugggcaccacccagcucgucccguccaacaucugcagccugcgcgggcggaucaacgcccaccuguccgacaaccagcaccgcuggaacaugcaggucaccaacgcgaacggcacgcccuucgaccccaccgaggacgcccccgccccgcucgggacccccgacuuccuggccaacaucuacggcgugaccagccagcggaaccccgacaacacgugccgcgcccacgacgggauccuggcgaccuggucccccaaguucaccccgaagcucggcagcguggugcugggcaccugggaggaccgggacuucgacaucaaccagcccacgcgcuucacccccgucgggcuguacgacaccgaccacuucaaccagugggcccuccccaacuacagcggcgcccugacccugaacaugaaccucgccccguccguggcgccccuguuccccggggagcagcuccuguucuuccggagccacaucccccugaagggcgggacguccaacggcgccaucgacugccugcucccgcaggagugggugcagcacuucuaccaggagagcgcccccuccagcaccgacgucgcccugauccgcuacaccaaccccgacaccggccgggugcuguucgaggccaagcugcaccgccagggguucaucacgguggcgaacuccggcagccgccccaucgucgugccgcccaacggguacuuccgguucgacuccugggugaaccaguucuacagccucgcccccaugggcaccgggaacggccgccggcgcguccaguga

SEQ ID NO: 12851 - RNA, 1608 nt, Artificial Sequence
  derived and/or modified sequence opt1 from VP1__Norovirus_and/or_Norovirus-like__AF414416
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggagauccugcucaaccuggagcugggccccgagcucaacccguuccuggcccaccugucccgcauguacaacggcuacgccgggggcguggagguccaggugcuccuggccgggaacgccuucaccgccggcaagcugguguucgcggccaucccgccccacuuccccaucgggaaccucagccccggccagaucgccauguucccccacgucaucaucgacgugcggacccuggagcccgugcugcucccccugccggacguccgcaacaacuucuuccacuacaaccaggagcccgagccccggaugcgccugguggccaugcucuacacgccccugcgguccaacggcagcggggacgacguguucaccgucuccugccgcgugcugacccggccgagccccgacuucgacuucaacuaccucgugccgcccaccgucgaguccaagaccaagcccuucacgcugcccauccugaccaucggcgagcucagcaacucccgcuuccccgugcccaucgacgagcuguacaccagcccgaacgaggggcuggugguccagccccagaacggccgguccacccucgacggcgagcugcuggggacgacccagcucgugcccagcaacaucugcucccugcgcggccggaucaacgcccaccugagcgacaaccagcaccgcuggaacaugcaggucaccaacgcgaacgggaccccguucgaccccacggaggacgugcccgcgccccucggcaccccggacuuccuggccaacaucuacggggugaccucccagcggaaccccgacaacacgugccgcgcccacgacggcauccuggccaccuggagccccaaguucacccccaagcucggcagcgucgugcuggggaccugggaggaccgggacuucgacaucaaccagccgacccgcuucacgcccgugggccuguacgacaccgaccacuucaaccaguggguccuccccuacuacuccggggcccugacccugaacaugaaccucgcccccagcguggccccgcuguuccccggcgagcagcuccuguucuuccggucccacgugccccugaagggcgggaccagcaacggcgccaucgacugccugcucccccaggaguggguccagcacuucuaccaggaguccgccccgagcuccacggacguggcgcugauccgcuacaccaaccccgacaccgggcgggugcuguucgaggccaagcugcaccgccagggcuucaucaccgucgccaacagcgggucccgccccaucguggugcccccgaacggcuacuuccgguucgacagcugggucaaccaguucuacucccucgcccccauggggacgggcaacggccgccggcgcgugcaguga

SEQ ID NO: 12852 - RNA, 1608 nt, Artificial Sequence
  derived and/or modified sequence opt1 from VP1__Norovirus_and/or_Norovirus-like__AF414419
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggagauccugcucaaccuggagcugggccccgagcucaacccguuccuggcccaccugucccgcauguacaacggcuacgccgggggcguggagguccaggugcuccuggccgggaacgccuucaccgccggcaagcugguguucgcggccaucccgccccacuuccccaucgagaaccucagccccgggcagaucaccauguucccccacgucaucaucgacgugcggacccuggagcccgugcugcucccccugccggacguccgcaacaacuucuuccacuacaaccaggagcccgagccccggaugcgccugguggccaugcucuacacgccccugcgguccaacggcagcggcgacgacguguucaccgucuccugccgcgugcugacccggccgagccccgacuucgacuucaacuaccucgugccgcccaccgucgaguccaagacgaagcccuucacccugcugauccucaccaucggggagcugagcaacucccgcuuccccgcccccaucgacgagcuguacaccagccccaacgagggccucguggugcagccgcagaacgggcgguccacgcuggacggcgagcugcucggcaccacccagcugguccccagcaacaucugcucccugcgcgggcggaucaacgcccaccucagcgacaaccagcaccgcuggaacaugcaggucaccaacgcgaacggcacgcccuucgacccgaccgaggacgugcccgcgccccuggggacccccgacuuccuggccaacaucuacggcgugaccucccagcggaacccggacaacacgugccgcgcccacgacgggauccucgccaccuggagccccaaguucacccccaagcugggcagcgugguccugggcaccugggaggaccgggacuucgacaucaaccagcccgcccgcuucacgccgguggggcucuacgacaccgaccacuucaaccagugggcccugcccaacuacuccggcgcccugacccucaacaugaaccuggcccccagcguggcgccccuguucccgggggagcagcuccuguucuuccggucccacaucccccugaagggcgggaccagcaacggcgccaucgacugccuccugccccaggaguggguccagcacuucuaccaggaguccgcccccagcuccacggacguggcccugauccgcuacaccaacccggacaccggccgggugcuguucgaggccaagcuccaccgccagggguucaucaccgucgcgaacagcggcucccgccccaucguggugccgcccaacggguacuuccgguucgacagcugggucaaccaguucuacucccuggcccccaugggcacggggaacggccgccggcgcgugcaguga

SEQ ID NO: 12853 - RNA, 1608 nt, Artificial Sequence
  derived and/or modified sequence opt1 from VP1__Norovirus_and/or_Norovirus-like__AF425767
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggagauccugcucaaccuggagcugggccccgagcucaacccguuccuggcccaccugucccgcauguacaacggcuacgccgggggcguggagguccaggugcuccuggccgggaacgccuucaccgccggcaagcugguguucgcggccaucccgccccacuuccccaucgagaaccucagccccgggcagaucaccauguucccccacgucaucaucgacgugcggacccuggagcccgugcugcucccccugccggacguccgcaacaacuucuuccacuacaaccaggaccccgagccccggaugcgccugguggccaugcucuacacgccccugcgguccaacggcagcggcgacgacguguucaccgucuccugccgcgugcugacccggccgagccccgacuucgacuucaacuaccucgugccgcccaccgucgaguccaagacgaagcccuucacccugcccauccugaccaucggggagcucagcaacucccgcuuccccgcccccaucgacgagcuguacaccagcccgaacgagggccugguggugcagccccagaacgggggcuccacgcucgacggcgagcugcuggggaccacccagcucguccccagcaacaucugcucccugcggggccgcaucaacgcccaccugagcgacaaccagcaccgguggaacaugcaggucaccaacgugaacgggacgccguucgaccccaccgaggacgugcccgcgccccucggcaccccggacuuccuggccaacaucuacgggaucaccucccagcgcaaccccgacaacacgugccgggcccacgacggcauccuggccaccuggagccccaaguucacccccaagcucggcagcgugguccuggggaccugggaggaccgcgacuucgacaucaaccagccgacgcgguucacccccgugggccuguacgacaccgaccacuucaaccagugggcccuccccaacuacuccggggcgcugacccugaacaugaaccucgcccccagcguggccccgcuguuccccggcgagcagcuccuguucuuccgcucccacaucccccugaagggcgggacgagcaacggcgccaucgacugccugcucccccaggaguggguccagcacuucuaccaggaguccgccccgagcuccaccgacguggcgcugauccgguacaccaaccccgacaccgggcgcgugcuguucgaggccaagcugcaccggcagggcuucaucacggucgccaacagcgggucccgccccaucguggugcccccgaacggcuacuuccgcuucgacagcugggucaaccaguucuacucccucgcccccauggggaccggcaacggccggcgccgggugcaguga

SEQ ID NO: 12854 - RNA, 1608 nt, Artificial Sequence
  derived and/or modified sequence opt1 from VP1__Norovirus_and/or_Norovirus-like__DQ093065
augaagauggccagcaacgacgccgcgcccuccaacgacggcgccgccgggcuggugccggaggucaacaacgagaugauggcccucgagcccguggccggcgcgagcaucgccgcgccccugaccgggcagaacaacgugaucgaccccuggauccgcaugaacuucguccaggccccgaacggcgaguucaccgugagcccccggaacucccccggggagauccugcucaaccuggagcugggccccgagcucaacccguuccuggcccaccugucccgcauguacaacggcuacgccgggggcguggagguccaggugcuccuggccgggaacgccuucacggccggcaagcugguguucgcggccaucccgccccgguuccccaucgagaaccucagccccgggcagaucaccauguucccccacgucaucaucgacgugcgcacccuggagcccgugcugcucccccugccggacguccggaacaacuucuuccacuacaaccaggagcccgagccccgcaugcggcugguggccaugcucuacacgccccugcgcuccaacggcagcggcgacgacguguucaccgucuccugccgggugcugacccgcccgagccccgacuucgacuucaacuaccucgugccgcccaccgucgaguccaagaccaagcccuucacgcugcccauccugaccaucggggagcucagcaacucccgguuccccgcccccaucgacgagcuguacaccagcccgaacgagggccugguggugcagccccagaacgggcgcuccacccucgacggcgagcugcugggcacgacccagcucguccccagcaacaucugcucccugcgggggcgcaucaacgcccaccucccggacaaccagcaccgguggaacaugcaggucaccaacgcgaacggcacccccuucgaccccacggaggacgugcccgccccgcucgggacccccgacuuccuggccaacaucuacggcgugaccagccagcgcaaccccgacaacacgugccgggcccacgacgggauccuggccaccuggucccccaaguucaccccgaagcucggcagcgugguccugggcaccugggaggaccgcgacuucgacaucaaccagcccacccgguucacgcccguggggcuguacgacaccgaccacuucaaccagugggcgcuccccaacuacagcggcgcccugacccugaacaugaaccucgccccguccguggcgccccuguuccccggggagcagcugcuguucuuccgcagccacaucccccugaagggcgggaccuccaacggcgccaucgacugccugcucccgcaggaguggguccagcacuucuaccaggagagcgcccccuccagcacggacguggcccugauccgguacaccaaccccgacaccggccgcgugcuguucgaggccaagcugcaccgccagggguucaucaccgucgccaacuccggcagccggcccaucguggugccgcccaacggguacuuccgcuucgacuccugggucaaccaguucuacagccucgcgcccaugggcacggggaacggccggcgccgggugcaguga

SEQ ID NO: 12855 - RNA, 1608 nt, Artificial Sequence
  derived and/or modified sequence opt1 from VP1__Norovirus_and/or_Norovirus-like__KJ194507
augaagauggccagcaacgacgccgcgcccuccaacgacggcgccgccgggcuggugcccgaggucaacaacgagaccauggcccucgagcccguggccggcgcgagcaucgccgcgccccugaccgggcagaacaacgugaucgaccccuggauccgcaugaacuucguccaggccccgaacggcgaguucacggugagcccccggaacucccccggggaggugcugcucaaccuggagcugggccccgagcucaacccguuccuggcccaccugucccgcauguacaacggcuacgccgggggcgucgagguccaggugcuccuggccgggaacgccuucaccgccggcaagcugguguucgcggccaucccgccccacuucccccucgagaaccugagccccgggcagaucaccauguucccccacgugaucaucgacgugcggacccuggagcccguccuccugccccugccggacgugcgcaacaacuucuuccacuacaaccagcagcccgagccccggaugcgccucguggccaugcuguacacgccccugcgguccaacggcagcggcgacgacgucuucaccguguccugccgcgugcucacccggccgagccccgacuucgacuucaacuaccuggucccgcccaccguggaguccaagacgaagcccuucacccugcccauccucaccaucggggagcugagcaacucccgcuuccccgugcccaucgacgagcuguacaccagcccgaacgagggcgucguggugcagccccagaacgggcgguccacgcucgacggcgagcugcugggcaccacccagcucguccccagcaacaucugcgcccugcgcgggcggaucaacgcccaggugccggacgaccaccaccaguggaaccugcaggucaccaacacgaacggcacccccuucgaccccaccgaggacgugcccgcgccgcucgggacccccgacuuccuggccaacaucuacggcgugacgucccagcgcaaccccaacaacacgugccgggcccacgacgggguccuggccaccuggagccccaaguucaccccgaagcucggcuccguggugcugggcaccugggaggagagcgaccuggaccucaaccagcccacccgcuucacccccgucgggcuguucaacaccgaccacuucgaccagugggugcugcccaacuacagcggccggcucacgcugaacaugaaccuggccccguccgugagcccccucuuccccggggagcagauccuguucuuccgcucccacaucccccugaagggcgggaccagcgacggcgcgaucgacugccuccugccgcaggaguggauccagcacuucuaccaggaguccgcccccagccccaccgacgucgcccugauccgguacaccaaccccgacacgggccgcgugcuguucgaggccaagcuccaccggcagggguucaucaccguggccaacuccggcagccgcccgaucgucgugccgcccaacggguacuuccgcuucgacuccugggugaaccaguucuacagccuggcgcccaugggcaccgggaacggccggcgccggguccaguga

SEQ ID NO: 12856 - RNA, 1608 nt, Artificial Sequence
  derived and/or modified sequence opt1 from VP1__Norovirus_and/or_Norovirus-like__KP064099
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggccccgaacggcgaguucacggugagcccccggaacucccccggggaggugcuccugaaccuggagcucggccccgagcugaacccguaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccccacgugaucaucgacguccggacccuggagcccgugcuccugccccugccggacgugcgcaacaacuucuuccacuacaaccagcagaacgagccccggaugcgccucgucgccaugcuguacacgccccugcgguccaacggcagcggcgacgacguguucaccguguccugccgcguccucacccggcccagcccggacuucgacuucaacuaccuggugccgcccaccguggaguccaagacgaagcccuucacccugcccauccucaccaucggggagcugaccaacagccgcuuccccguccccaucgacgagcuguacacgucccccaacgagagccucguggugcagccgcagaacggccggugcgcccuggacggggagcugcagggcaccacccagcuccugcccaccgccaucugcuccuuccgcggccggaucaaccagaaggucagcggggacaaccacguguggaacaugcaggucacgaacaucaacggcacccccuucgacccgaccgaggacgugcccgcgccccuggggacccccgacuucuccggcaagcuguucggggugcucagccagcgcgaccacgacaacgccugccggucccacgacgccgucaucgccacggacagcgccaaguucaccccgaagcugggcgcgauccagaucggcaccugggaggaggacgacgugcacaucaaccagcccaccaaguucacgcccgugggccucuucgagcgcgagggguucaaccaguggacccugcccaacuacagcggggcccugacccucaacaugggccuggccccgcccgucgcccccaccuuccccggggagcagauccuguucuuccggucccacaucccgcucaagggcggcguggccgaccccgugaucgacugccugcugccccaggaguggauccagcaccucuaccaggagagcgcgcccucccagacggacgucgcccugauccgcuucaccaacccggacaccgggcgggugcuguucgaggccaagcuccaccgcagcggcuacaucaccguggccaacacggggucccggcccaucgucgugcccgcgaacggcuacuuccgcuucgacagcugggugaaccaguucuacucccuggcccccauggggaccggcaacggccgccggcgcguccaguga

SEQ ID NO: 12857 - RNA, 1608 nt, Artificial Sequence
  derived and/or modified sequence opt1 from VP1__Norovirus_and/or_Norovirus-like__AB303926
augaagauggccagcaacgacgccacccccuccgacggcagcaccgcgaaccuggugccggaggucaacaacgaggugauggcccucgagcccguggucggggccgccaucgccgcgcgcguggccggccagcagaacgugaucgaccccuggauccggaacaacuucguccaggcccccgggggcgaguucacgguguccccgcgcaacgcccccggggagauccuguggagcgcgccccugggccccgaccucaacccguaccugucccaccuggcccggauguacaacggcuacgccgggggcuucgaggugcaggucauccucgccgggaacgccuucaccgcgggcaagaucaucuucgccgccgugccgcccaacuuccccaccgaggggcugagccccucccaggugaccauguucccccacaucaucgucgacgugcgccagcuggagcccgugcucaucccccugccggacguccggaacaacuucuaccacuacaaccagagcaacgacuccacgaucaagcugaucgccaugcucuacacgccccugcgcgccaacaacgcgggcgacgacguguucaccgugagcugccggguccugacccgccccucccccgacuucgacuucaucuuccucgugccgcccaccguggagagccggaccaagcccuucaccguccccauccugaccguggaggagauguccaacagccgcuucccggugccccuggagaagcucuacacgggccccuccagcgccuucgucgugcagccccagaacgggcggugcaccaccgacggcguccugcuggggaccacgcagcucuccgccgugaacaucugcaccuuccgcggcgacgugacccacaucgccggcagccacgacuacaccaugaaccuggccucccagaacuggaacaacuacgacccgacggaggagauccccgcgccccuggggaccccggacuucgucggcaagauccagggggugcucacccagaccacgcgggaggacggcagcacccgcgcccacaaggccaccgugagcaccggguccguccacuucacgcccaagcugggcagcgugcaguacaccaccgacaccaacaacgacuuccagacgggccagaacaccaaguucacccccgugggggucauccaggacggcuccaaccaccagaacgagccccagcagugggugcugccgaacuacagcgggcggaccggccacaacgugcaccucgcccccgccgucgcgcccacguuccccggggagcagcugcuguucuuccgcuccaccaugccgggcugcagcggcuaccccaacaugaaccucgacugccugcugccccaggagugggugcagcacuucuaccaggaggccgcccccgcccaguccgacguggcgcuccugcgguucgucaacccggacaccgggcgcgugcuguucgagugcaagcuccacaagagcggcuacgugaccgucgcccacaccgggccccacgaccuggugaucccgcccaacggcuacuuccgguucgacuccugggugaaccaguucuacacgcuggcccccauggggaacggcgccggccgcuga

SEQ ID NO: 12858 - RNA, 1608 nt, Artificial Sequence
  derived and/or modified sequence opt1 from VP1__Norovirus_and/or_Norovirus-like__KU985166
augaagauggccagcuccgacgccaaccccagcgacggcuccaccgcgagccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucuccguccccauccugaccguggaggagaugaccaacagccgguuccccaucccccuggagaagcuguucaccggccccuccagcacguucgugguccagccgcagaacgggcgcugcaccaccgacggcgugcuccuggggaccacgcagcucucccccgucaacaucugcaccuuccggggcggcaucacccgcaucgggcagagcgagagcuacaagaugaaccuggccucccagaacuggaacaacuacgaccccaccgaggagaucccggcgccccugggcacgcccgacuucaaggggcggauccgcggccuccugacccagaccaccaagggggccggcagcacgcggggccacaaggccaccgugcugaccgggggcuccgacuucacccccaagcucgggacggugcgcuucgacaccaagagcaucgacuucgagaacaaccagaacaccaaguucaccccggucggcguggugcaggacgggaacaaccacgacgagcccacgcaguggguccugcccaacuacuccggccccgacacccacaacgugcaccuggccccggccguggcccccaccuuccccggcgagcagcuccuguucuuccggagcaccaugcccgggugcuccggcuacccgaagauggagcuggacugccuccugccccaggaguggguccagcacuucuaccaggaggccgcccccgcgcagacggacguggcccugcuccgcuucgugaaccccgacaccgggcggguccuguucgagugcaagcugcacaagagcggcuacgugaccguggcccacaccggggaccacgaccucgucaucccgcccaacggcuacuuccgcuucgacuccugggugaaccaguucuacacccuggcccccaugggcaacgggacgggccggcgccgcuga

SEQ ID NO: 12859 - RNA, 1608 nt, Artificial Sequence
  derived and/or modified sequence opt1 from VP1__Norovirus_and/or_Norovirus-like__JN699045
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguuccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacgugccccucaaggaccuguccaacagccgggugcccgucccgauccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggacccccuucaucccgcuggagucccccgcccccgugggcuucccggaccugggcgggugcgacuggcacgugaacuucaccuuccaggcgcagaaccaggaccccagccaguccgucaccuucgccacgaacgacgccagcuucgugcccuaccucggcuccaucagcccccacaacgggggcgacuuccacuccggggacaucaucggcagccugggcuggaucuccgccccgagcgacuccagccagcugaacguguggaccauccccaaguacggguccagccuccccgacgucacccaccuggcccccgcgguguucccgcccggcuucggggaggugauccuguacuuccacuccaccuuccccggcagcgggcagcccggccagcuccaggucccgugccugcugccccaggaguucaucacgcacuucugcaacgagcaggcccccaucgccggcgaggccgcgcuccugcacuacguggaccccgacaccgggcggaaccugggcgaguucaagcucuacccggacggguucaugaccugcgugcccaacuccgucagcuccggcccccagacccugcccaucaacggcguguucguguucgucagcugggugagccgcuucuaccagcugaagccgguggggacggccuccgccgcccggcgccucuga

SEQ ID NO: 12860 - RNA, 1608 nt, Artificial Sequence
  derived and/or modified sequence opt1 from VP1__Norovirus_and/or_Norovirus-like__EF547395
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguuccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacgugccccucaaggaccuguccaacagccgggugcccgucccgauccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggucccccuucaucccgcuggagagccccgcccccgugggcuucccggaccugggcgggugcgacuggcacgugaacuucaccuuccaggcgcaggaccaggaccccucccagagcgucaccuucgccaccaacgacgccuccuucgugcccuaccucggcagcaucagcccccacaacgggggcgacuuccacuccggggacaucaucggcucccugggcuggaucagcgccccguccgacagcucccagcugaacguguggacgauccccaaguacgggagcucccuccccgacgucacccaccuggcccccgcgguguucccgcccggcuucggggaggugauccuguacuucuacagcaccuuccccggcuccgggcagcccggccagcuccaggucccgugccugcugccccaggaguucaucacccacuucugcaacgagcaggcccccaucgccggcgaggccgcgcuccugcacuacguggaccccgacacggggcggaaccugggcgaguucaagcucuacccggacggguucaugaccugcgugcccaacagcgucuccagcggcccccagacccugcccaucaacggcguguucguguucgucagcugggugucccgcuucuaccagcugaagccgguggggaccgccagcgucgcccggcgccucuga

SEQ ID NO: 12861 - RNA, 1608 nt, Artificial Sequence
  derived and/or modified sequence opt1 from VP1__Norovirus_and/or_Norovirus-like__AY502008
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguuccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacgugccccucaaggaccuguccaacagccgggugcccgucccgauccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggucccccuucaucccgcuggagagccccgcccccgugggcuucccggaccugggcgggugcgacuggcacgugaacuucaccuuccaggcgcaggaccaggaccccucccagagcgucaccuucgccaccaacgacgccuccuucgugcccuaccucggcagcaucagcccccacaacgggggcgacuuccacuccggggacaucaucggcucccugggcuggaucagcgccccguccgacagcucccagcugaacguguggacgauccccaaguacgggagcucccuccccgacgucacccaccuggcccccgcgguguucccgcccggcuucggggaggugauccuguacuucuacagcaccuuccccggcuccgggcagcccguccagcuccaggugccgugccugcugccccaggaguucaucacccacuucugcaacgagcaggcccccaucgccggcgaggccgcgcuccugcacuacguggaccccgacacgggccggaaccugggggaguucaagcucuacccggacggcuucaugaccugcguccccaacagcguguccagcgggccccagacccugcccaucaacggcguguucgucuucgugagcugggugucccgcuucuaccagcugaagccggucggcaccgccagcguggcccggcgccucuga

SEQ ID NO: 12862 - RNA, 1608 nt, Artificial Sequence
  derived and/or modified sequence opt1 from VP1__Norovirus_and/or_Norovirus-like__AY502007
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucgucccgcuggagucccccgcccccgugggcuucccggaccugggcgggugcgacuggcacgugaacuucaccuuccaggcgcagaaccaggaccccagccaguccgucaccuucgccacgaacgacgccagcuucgugcccuaccucggcuccaucagcccccacaacgggggcgacuuccacgccggggacaucaucggcucccugggcuggaucagcgccccguccgacaacacccagcugaacguguggaccauccccaaguacgggagcucccuccccgacgucacccaccuggcgcccgccguguucccgcccggcuucggggaggugauccuguacuucuacagcacguuccccggcuccgggcagcccagccagcuccaggucccgugccugcugccccaggaguucaucacccacuucugcaacgagcaggcccccaucgccggcgaggcggcccuccugcacuacguggaccccgacaccggccggaaccugggggaguucaagcucuacccggacggcuucaugaccugcgugcccaacuccgucagcuccgggccccagacgcugcccaucaacggcguguucguguucgucagcugggugucccgcuucuaccagcugaagccggugggcaccgccagcgccgcccggcgccucuga

SEQ ID NO: 12863 - RNA, 1608 nt, Artificial Sequence
  derived and/or modified sequence opt1 from VP1__Norovirus_and/or_Norovirus-like__KC998959
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgguccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggacccccuucaucccgcuggagucccccgcccccgugggcuucccggaccugggcgggugcgacuggcacgugaacuucaccuuccaggcgcaggaccaggaccccagccaguccgucaccuucgccacgaacgacgccagcuucgugcccuaccucggcuccaucagcccccacaacgggggcgacuuccacgccggggacaucaucggcucccugggcuggaucagcgccccguccgggaacagccagcugaacgugugggcgauccccaaguacggcuccagccuccccgacgucacccaccuggcccccgccguguucccgcccggguucggcgaggugauccuguacuucuacuccaccuuccccgggagcggccagcccucccagcuccaggucccgugccugcugccccaggaguucaucacccacuucugcaacgagcaggcccccaucgcgggcgaggccgcccuccugcacuacguggaccccgacacggggcggaaccugggcgaguucaagcucuacccggacggguucaugaccugcgugcccaacagcgucuccagcggcccccagacccugcccaucaacggcguguucguguucgucuccugggugagccgcuucuaccagcugaagccgguggggaccgccagcgccgcgcggcgccucuga

SEQ ID NO: 12864 - RNA, 1608 nt, Artificial Sequence
  derived and/or modified sequence opt1 from VP1__Norovirus_and/or_Norovirus-like__GQ856464
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgucggcuucccggaccugggcgggugcgacuggcacgugaacuucaccuuccagacccaggaccgggaccccagccaguccgugacguucgcgaccaacgacgccagcuucguccccuaccucggcuccgugagcccccacaacggggagggcuuccaggccggggacaucaucggcucccugggcuggaucagcgccccguccgacaacagccaguucaacgugugggccauccccaaguacggguccagccugcccgacgucacccaccucgcgcccgccguguucccgcccggcuucggggaggugauccuguacuucuacuccaccuuccccggcagcgggcagcccucccagcugcaggucccgugccuccugccccaggaguucaucacgcacuucugcaacgagcaggcccccaucgccggcgaggcggcccugcuccacuacguggaccccgacaccggccgcaaccugggggaguucaagcuguacccggacggcuucaugaccugcgugcccaacagcgucuccagcgggccccagacccuccccaucaacggcguguucguguucgucuccugggugagccgguucuaccagcugaagccggugggcacggccagcgccgcccgccggcuguga

SEQ ID NO: 12865 - RNA, 1608 nt, Artificial Sequence
  derived and/or modified sequence opt1 from VP1__Norovirus_and/or_Norovirus-like__GQ856463
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacauggucgaccccuggaucuucaacaacuucgugcaggcgccgcagggggaguucaccaucucccccaacaacacccccggcgacauccucuucgaccugcagcugggcccccaccucaacccguuccuggcccaccugagccagauguacaacgggugggugggcaacaugcgcguccggauccuccuggccgggaacgccuucacggccggcaagaucaucaucugcugcgugccgcccggguucgacgcgcgcauccugaccaucgcccaggccacccucuucccccaccugaucgccgacgugcggacccuggagcccgucgagcucccccuggaggacgugcgcaacgugcuguaccacaacuccagccagccccagcccacgaugcggcucgucgccaugcuguacaccccgcugcgcaccggcggcggguccggcgggaccgacgcguucgugguggccggccggguccucacgugccccgcccccgacuucagcuuccuguuccuggugcccccguccguggagcagaagacccgcgucuucagcgugcccaacaucccccucaaggaccuguccaacagccgggugcccgucccgauccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggacccccuucaucccgcuggagucccccgcccccgugggcuucccggaccugggcgggugcgacuggcacgugaacuucaccuuccagacccaggaccgggaccccagccaguccgucacguucgcgaccaacgacgccagcuucgugcccuaccucggcuccgugagcccccacaacggggagggcuuccaggccggggacaucaucggcucccugggcuggaucagcgccccguccgacaacagccaguucaacgucugggccauccccaaguacggguccagccugcccgacgugacccaccucgcgcccgccguguucccgcccggcuucggggaggucauccuguacuucuacuccaccuuccccggcagcgggcagcccucccagcuccaggugccgugccugcugccccaggaguucaucacgcacuucugcaacgagcaggcccccaucgccggcgaggcggcccugcuccacuacguggaccccgacaccggccgcaaccugggggaguucaagcuguacccggacggcuucaugaccugcguccccaacagcguguccagcgggccccagacccuccccaucaacggcguguucgucuucguguccugggugagccgguucuaccagcugaagccggucggcacggccagcgccgcccgccggcuguga

SEQ ID NO: 12866 - RNA, 1608 nt, Artificial Sequence
  derived and/or modified sequence opt1 from VP1__Norovirus_and/or_Norovirus-like__KM036372
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccguggagcagaagacccgcguguucagcguccccaacaucccccucaaggaccuguccaacagccgggugcccgugccgguccagggcauguucgugucccccgacgugaaccagagcguccaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgugggcuucccggaccugggcgggugcgacuggcacgucaacuucaccuuccagacccaggaccgggaccccagccaguccgugacguucgcgaccaacgacgccagcuucgugcccuaccucggcuccgucagcccccacaacggggagggcuuccaggccggggacaucaucggcucccugggcuggaucagcgccccguccgacaacagccaguucaacgugugggccauccccaaguacggguccagccugcccgacgugacccaccucgcgcccgccgucuucccgcccggcuucggggaggugauccuguacuucuacuccaccuuccccggcagcgggcagcccucccagcugcaggucccgugccuccugccccaggaguucaucacgcacuucugcaacgagcaggcccccaucgccggcgaggcggcccugcuccacuacgucgaccccgacaccggccgcaaccugggggaguucaagcuguacccggacggcuucaugaccugcgugcccaacagcguguccagcgggccccagacccuccccaucaacggcgucuucguguucguguccugggucagccgguucuaccagcugaagccggugggcacggccagcgccgcccgccggcuguga

SEQ ID NO: 12867 - RNA, 1608 nt, Artificial Sequence
  derived and/or modified sequence opt1 from VP1__Norovirus_and/or_Norovirus-like__AF538678
augaagauggccagcaaggacgcgcccccgucccccgacggcgccagcggggccggccagcuggugcccgaggucaacaccgccgaccagaucuccauggaccccguggccggggccagcaccgcgguggccacggccggccaggucaacaugaucgacccguggaucuucaacaacuucgugcaggcgccccagggggaguucaccaucucccccaacaacacccccggcgacauccucuucgaccugcagcugggcccgcaccucaaccccuuccuggcccaccugagccagauguacaacgggugggugggcaacaugcgcguccggauccuccuggccgggaacgccuucaccgccggcaagaucaucaucugcugcgugccgcccggguucgacgcccgcauccugacgaucgcgcaggccacccucuucccccaccugaucgccgacgugcggacccuggagcccgucgagcucccccuggaggacgugcgcaacgugcuguaccacaacuccagccagccccagccgaccaugcggcucgucgccaugcuguacacgccccugcgcaccggcggcggguccggcgggaccgacgccuucgugguggcgggccggguccugaccugccccgcccccgacuucagcuuccucuuccuggugccgcccuccguggagcagaagacgcgcgucuucagcgugcccaacaucccccucaaggaccuguccaacagccgggugccgacccugauccagggcauguucgucucccccgacgugaaccagagcgugcaguuccagaacgggcgcugccagaucgacggccagcuccaggggaccacccccgucucccugagccagcugugcaagauccggggcaagacguccagcaacacccgcgugcucaaccugagcgaggucgacgggacccccuucgugccgcuggagucccccgcccccgugggcuucccggacaucggcgggugcgacuggcacgucggcuucaccuucgaggcccgggaccaggaccccagccagaacgugacguucgccaccaacgacuccagcuucgugcccuaccucggguccaucagcccccacaacggcgacggguuccacuccggcgacaucgucggcagccuggacuggaucuccgcgccgagcgacggguccgcccuggacguguggagcauccccaaguacggcuccagccuccccgacgugacccaccuggcccccgucguguucccgcccggguucggcgaggugauccuguacuuccacuccaaguuccccgggagcggccccaccgacaagcuccgcgucccgugccugaugccccaggaguucaucacgcacuucugcaacgagcaggcccccaucgccggcgaggcggcccugcuccacuacguggaccccgacaccgggcggaaccugggcgaguucaagcuguacuccgacggguucaugaccugcgugccgaacagcaucuccagcggcccccagacccuccccaucaacggcgucuucguguucgugagcugggucucccgcuucuaccagcugaagcccguggggacggccagcgccgcgcggcgccuguga

SEQ ID NO: 12868 - RNA, 1608 nt, Artificial Sequence
  derived and/or modified sequence opt1 from VP1__Norovirus_and/or_Norovirus-like__KC294198
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguuccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgguccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggacccccuucaucccgcuggagucccccgcccccgugggcuucccggaccugggcgggugcgacuggcacgugaacuucaccuuccaggcgcagaaccaggaccccagccaguccgucaccuucgccacgaacgacgccagcuucgugcccuaccucggcuccaucagcccccacaacgggggcgacuuccacgccggggacaucaucggcucccugggcuggaucagcgccccguccgacaacagccagcugaacguguggaccauccccaaguacggguccagccuccccgacgucacccaccuggcgcccgccguguucccgcccggcuucggggaggugauccuguacuucuacuccaccuuccccggcagcgggcaguccagccagcuccagguccccugccugcugccgcaggaguucaucacgcacuucugcaacgagcaggcccccaucgccggcgaggcggcccuccugcacuacguggaccccgacaccggccggaaccugggggaguucaagcucuaccccgacggcuucaugaccugcgugccgaacuccgucagcuccgggccccagacccugcccaucaacggcguguucguguucgucagcugggugagccgcuucuaccagcugaagcccgugggcacggccuccgccgcccggcgccucuga

SEQ ID NO: 12869 - RNA, 1608 nt, Artificial Sequence
  derived and/or modified sequence opt1 from VP1__Norovirus_and/or_Norovirus-like__KT732280
augaugauggccagcaaggacgcccccaccuccccggacggcgcgagcggggccggccagcuggugcccgaggucaacaccgccgaccagaucuccauggaccccguggccggggccagcacggcgguggccaccgccggccaggucaacaugaucgaccccuggaucuucaacaacuucgugcaggccccgcagggggaguucaccaucucccccaacaacacccccggcgacauccucuucgaccugcagcugggcccccaccucaacccguuccuggcgcaccugagccagauguacaacgggugggugggcaacaugcgcguccggauccuccuggccgggaacgccuucacggccggcaagaucaucaucugcugcgugccgcccggguucgacgcccgcauccugaccaucgcgcaggccacccucuucccccacaugaucgccgacgugcggacccuggagcccgucgagcugccccucgaggacgugcgcaacgugcuguaccacaacuccagccagccccagcccacgaugcggcuggucgccaugcucuacaccccgcugcgcaccggcggcggguccggcgggaccgacgccuucgugguggcgggccggguccugacgugccccgcccccgacuucagcuuccucuuccuggugcccccguccguggagcagaagacccgcgucuucagcgugcccaacaucccccugaaggaccucuccaacagccgggugcccacccugauccagggcauguucgucuccccggacgugaaccagagcgugcaguuccagaacgggcgcugccagaucgacggccagcugcaggggaccacgcccgucucccucagccagcugugcaagauccggggcaagaccuccagcaacgcccgcgugcugaaccucagcgaggucgacgggacccccuucgugccccuggaguccccggcccccgugggcuuccccgaccugggcgggugcgacuggcacgucggcuucaccuucgaggcccgggaccaggacccgagccagaacgugacguucgcgaccaacgacuccagcuucgugcccuaccucggguccaucagcccccacaacggcgacggguuccacuccggcgacaucaucggcagccuggacuggaucuccgcccccagcgacggguccacccuggacgucuggagcaucccgaaguacggcuccagccuccccgacgugacccaccuggcccccgccguguucccgcccggguucggcgaggucauccuguacuuccacuccaaguuccccgggagcggccccacggacaagcuccgcgugcccugccugaucccgcaggaguucaucacccacuucugcaacgagcaggcccccaucgcgggcgaggccgcccugcuccacuacguggaccccgacaccgggcggaaccugggcgaguucaagcuguaccccgacggguucaugaccugcgucccgaacuccaucagcuccggcccccagacgcuccccaccaacggcguguucguguucgucagcugggugagccgcuucuaccagcugaagcccguggggaccgccuccauggcgcggcgccuguga

SEQ ID NO: 12870 - RNA, 1608 nt, Artificial Sequence
  derived and/or modified sequence opt1 from VP1__Norovirus_and/or_Norovirus-like__LC101822
augaugauggccagcaaggacgugcccaccuccccggacggcgccagcggggcgggccagcugguccccgaggugaacaccgccgaccagaucuccauggaccccguggccggggccagcacggccgucgcgaccgccggccaggugaacaugaucgaccccuggaucuucaacaacuucgugcaggccccgcagggggaguucaccaucucccccaacaacacccccggcgacauccucuucgaccugcagcugggcccccaccucaacccguuccuggcccaccugagccagauguacaacgggugggucggcaacaugcgcgugcggauccuccuggcggggaacgccuucacggccggcaagaucaucaucugcugcgugccgcccggguucgacgcccgcauccugaccaucgcccaggcgacccucuucccccaccugaucgccgacguccggacccuggagcccguggagcucccccuggaggacgugcgcaacguccuguaccacaacuccagccagccccagcccacgaugcggcucguggccaugcuguacaccccgcugcgcaccggcggcggguccggcgggaccgacgccuucguggucgccggccgggugcucacgugccccgcgcccgacuucagcuuccuguuccuggugcccccguccgucgagcagaagacccgcguguucagcgugcccaacaucccccucaaggaccuguccaacagccggguccccacccugauccagggcauguucguguccccggacgugaaccagagcguccaguuccagaacgggcgcugccagaucgacggccagcuccaggggaccacgcccgugucccugagccagcugugcaagauccggggcaagaccuccagcaacacccgcguccucaaccugagcgagguggacgggacccccuucgugccccuggaguccccggcccccgucggcuuccccgacaucggcgggugcgacuggcacgugggcuucacguucgaggcccgggaccaggggccgagccagaacgugaccuucgccaccaacgacuccagcuucguccccuaccucggcuccaucagcccccacaacggggacggcuuccacuccggcgacaucaucgggagccuggacuggaucuccgcccccagcgacggcuccgcgcuggacguguggagcaucccgaaguacggguccagccuccccgacgugacccaccuggcccccgccgucuucccgcccggcuucggggaggugauccuguacuuccacuccaaguuccccggcagcggccccacggacaagcuccgcgugcccugccugaugccgcaggaguucaucacccacuucugcgacgagcaggcccccaucgccggggaggcggcccugcuccacuacgucgaccccgacgccggccggaaccugggggaguucaagcuguaccccgacggcuucaugaccugcgugccgaacuccaucagcuccggcccccagacccuccccaucaacgggguguucgucuucgugagcugggugagccgcuucuaccagcugaagcccgucggcacggccuccauggcgcggcgccuguga

SEQ ID NO: 12871 - RNA, 1608 nt, Artificial Sequence
  derived and/or modified sequence opt1 from VP1__Norovirus_and/or_Norovirus-like__KP407451
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgucggcuucccggaccugggcgggugcgacuggcacgugaacuucagcuuccagacccaggaccgggaccccucccagagcgugaccuucgcgacgaacgacgccuccuucguccccuaccucggcagcgugagcccccacaacggggagggcuuccaggccggggacaucaucggcucccugggcuggaucuccgccccgagcgacaacucccaguucaacgugugggccauccccaaguacgggagcucccugcccgacgucacccaccucgcgcccgccguguucccgcccggcuucggggaggugauccuguacuucuacagcaccuuccccggcuccgggcagcccagccagcugcaggucccgugccuccugccccaggaguucaucacccacuucugcaacgagcaggcccccaucgccggcgaggcggcccugcuccacuacguggaccccgacacgggccgcaaccugggggaguucaagcuguacccggacggcuucaugaccugcgugcccaacuccgucagcuccgggccccagacccuccccaucaacggcguguucguguucgucagcugggugagccgguucuaccagcugaagccggugggcaccgccuccgccgcccgccggcuguga

SEQ ID NO: 12872 - RNA, 1608 nt, Artificial Sequence
  derived and/or modified sequence opt1 from VP1__Norovirus_and/or_Norovirus-like__LN854564
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgucggcuucccggaccugggcgggugcgacuggcacgugaacuucaccuuccaggcgcagaaccaggaccccagccaguccgugaccuucgccacgaacgacgccagcuucguccccuaccucggcuccaucagcccccacaacgggggcgacuuccacgccggggacaucaucggcucccugggcuggaucagcgccccguccgacaacagccagcugaacguguggaccauccccaaguacggguccagccuccccgacgugacccaccuggcgcccgccgucuucccgcccggcuucggggaggugauccuguacuucuacuccaccuuccccggcagcgggcagcccucccagcuccaggugccgugccugcugccccaggaguucaucacgcacuucugcaacgagcaggcccccaucgccggcgaggcggcccuccugcacuacgucgaccccgacaccggccggaaccugggggaguucaagcucuacccggacggcuucaugaccugcgugcccaacagcguguccagcgggccccagacccugcccaucaacggcgucuucguguucguguccugggucagccgcuucuaccagcugaagccggugggcacggccagcgccgcccggcgccucuga

SEQ ID NO: 12873 - RNA, 1608 nt, Artificial Sequence
  derived and/or modified sequence opt1 from VP1__Norovirus_and/or_Norovirus-like__JQ388274
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgguccagggcauguucaugucccccgacgugaaccagagcgugcaguuccagaacgggcgcugccagaucgacggccagcugcaggggaccacccccgucucccucagccagcugugcaagauccggggcaagacguccagcaacgcccgcgugcugaaccucagcgaggucgacgggacccccuucaucccgcuggagucccccgcccccgugggcuucccggaccugggcgggugcgacuggcacgugaacuucaccuuccaggcgcagaaccaggaccccagccaguccgucaccuucgccacgaacgacgccagcuucgugcccuaccucggcuccaucagcccccacaacgggggcgacuuccacgccggggacaucaucggcucccugggcuggaucagcgccccguccgacaacagccagcugaacguguggaccauccccaaguacggguccagccuccccgacgucacccaccuggcgcccgccguguucccgcccggcuucggggaggugauccuguacuucuacuccaccuuccccggcagcgggcagcccucccagcuccaggucccgugccugcugccccaggaguucaucacgcacuucugcaacgagcaggcccccaucgccggcgaggcggcccuccugcacuacguggaccccgacaccggccggaaccugggggaguucaagcucuacccggacggcuucaugaccugcgugcccaacagcgucuccagcgggccccagacccugcccaucaacggcguguucguguucgucuccugggugagccgcuucuaccagcugaagccggugggcacggccagcgccgcccggcgccucuga

SEQ ID NO: 12874 - RNA, 1608 nt, Artificial Sequence
  derived and/or modified sequence opt1 from VP1__Norovirus_and/or_Norovirus-like__KP027330
augaugauggccagcaaggacgcccccaccuccccggacggcgcgagcggggccggccagcuggugcccgaggucaacaccgccgaccagaucuccauggaccccguggccggggccagcacggcgguggccaccgccggccaggucaacaugaucgaccccuggaucuucaacaacuucgugcaggccccgcagggggaguucaccaucucccccaacaacacccccggcgacauccucuucgaccugcagcugggcccccaccucaacccguuccuggcgcaccugagccagauguacaacgggugggugggcaacaugcgcguccggauccuccuggccgggaacgccuucacggccggcaagaucaucaucugcugcgugccgcccggguucgacgcccgcauccugaccaucgcgcaggccacccucuucccccacaugaucgccgacgugcggacccuggagcccgucgagcugccccucgaggacgugcgcaacgugcuguaccacaacuccagccagccccagcccacgaugcggcuggucgccaugcucuacaccccgcugcgcaccggcggcggguccggcgggaccgacgccuucgugguggcgggccggguccugacgugccccgcccccgacuucagcuuccucuuccuggugcccccguccguggagcagaagacccgcgucuucagcgugcccaacaucccccugaaggaccucuccaacagccgggugcccacccugauccagggcauguucgucuccccggacgugaaccagagcgugcaguuccagaacgggcgcugccagaucgacggccagcugcaggggaccacgcccgucucccucagccagcugugcaagauccggggcaagaccuccagcaacgcccgcgugcugaaccucagcgaggucgacgggacccccuucgugccccuggaguccccggcccccgugggcuuccccgaccugggcgggugcgacuggcacgucggcuucaccuucgaggcccgggaccaggacccgagccagaacgugacguucgcgaccaacgacuccagcuucgugcccuaccucggguccaucagcccccacaacggcgacggguuccacuccggcgacaucaucggcagccuggacuggaucuccgcccccagcgacggguccacccuggacgucuggagcaucccgaaguacggcuccagccuccccgacgugacccaccuggcccccgccguguucccgcccggguucggcgaggucauccuguacuuccacuccaaguuccccgggagcggccccacggacaagcuccgcgugcccugccugaucccgcaggaguucaucacccacuucugcaacgagcaggcccccaucgcgggcgaggccgcccugcuccacuacguggaccccgacaccgggcggaaccugggcgaguucaagcuguaccccgacggguacaugaccugcgucccgaacuccaucagcuccggcccccagacgcuccccaccaacggcguguucguguucgucagcugggugagccgcuucuaccagcugaagcccguggggaccgccuccauggcgcggcgccuguga

SEQ ID NO: 12875 - RNA, 1608 nt, Artificial Sequence
  derived and/or modified sequence opt1 from VP1__Norovirus_and/or_Norovirus-like__AF093797
augaugauggccagcaaggacgcgcccccgucccccgacggcgccagcggggccggccagcuggugcccgaggucaacaccgccgaccagaucuccauggaccccguggccggggccagcaccgcgguggccacggccggccaggucaacaugaucgacccguggaucuucaacaacuucgugcaggcgccccagggggaguucaccaucucccccaacaacacccccggcgacauccucuucgaccugcagcugggcccgcaccucaaccccuuccuggcccaccugagccagauguacaacgggugggugggcaacaugcgcguccggauccuccuggccgggaacgccuucaccgccggcaaggugaucaucugcugcgugccgcccggguucgacgcccgcauccugacgaucgcgcaggccacccucuucccccaccugaucgccgacguccggacccuggagcccguggagcucccccuggaggacgugcgcaacguccuguaccacaacuccagccagccccagccgaccaugcggcucguggccaugcuguacacgccccugcgcaccggcggcggguccggcgggaccgacgccuucguggucgcgggccgggugcugaccugccccgcccccgacuucagcuuccucuuccuggugccgcccuccgucgagcagaagacgcgcguguucagcgugcccaacaucccccucaaggaccuguccaacagccgggucccgacccugauccagggcauguucgugucccccgacgugaaccagagcguccaguuccagaacgggcgcugccagaucgacggccagcuccaggggaccacccccgugucccugagccagcugugcaagauccggggccgcacguccagcaacacccggguccucaaccugagcgagguggacgggacccccuucgugccgcuggagucccccgcccccgucggcuucccggacaucggcgggugcgacuggcacgugggcuucaccuucgaggcccgcgaccaggaccccagccagaacgugacguucgccaccaacgacuccagcuucguccccuaccucggguccaucagcccccacaacggcgacggguuccacuccggcgacaucaucggcagccuggacuggaucuccgcgccgagcgacggguccgcccuggacguguggagcauccccaaguacggcuccagccuccccgacgugacccaccuggcccccgccgucuucccgcccggguucggcgaggugauccuguacuuccacuccaaguuccccgggagcggccccaccgacaagcuccgggugccgugccugaucccccaggaguucaucacgcacuucugcaacgagcaggcccccaucgcgggcgaggccgcccugcuccacuacgucgaccccgacaccgggcgcaaccugggcgaguucaagcuguacccggacggguucaugaccugcgugcccaacuccaucagcuccggcccccagacccuccccaucaacggcguguucgucuucgugagcugggugagccgguucuaccagcugaagccggucgggacggccuccgcggcccgccggcuguga

SEQ ID NO: 12876 - RNA, 1608 nt, Artificial Sequence
  derived and/or modified sequence opt1 from VP1__Norovirus_and/or_Norovirus-like__AB810006
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaaccgcggggacaacugggaccagaaccugcugcagcucaccuaccccagcggcgccuccuacgacccgaccgacgaggugcccgcgccccugggcacgcaggacuucagcgggauccuguacggcgugcucacccaggacaacgucagcgaggggaccggcgaggccaagaacgccaaggggguguacaucuccaccacgagcggcaaguucacccccaagaucggcuccaucgggcugcacagcaucaccgagaacguccacccgaaccagcagucccgguucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccgcagccgggugcccugcguccaggggcugcgcggccaggacgcguucaucgacugccuccugccgcaggagugggugaaccacuucuaccaggaggccgcccccucccaggccgacguggcccugauccgguacgucaaccccgacaccggccgcacccucuucgaggcgaagcugcaccggagcggguucaucacggugucccacaccggcgccuacccccugguggucccgcccaacgggcccuuccgcuucgacagcugggugaaccaguucuacucccucgcccccaugggcaccggguga

SEQ ID NO: 12877 - RNA, 1605 nt, Artificial Sequence
  derived and/or modified sequence opt1 from VP1__Norovirus_and/or_Norovirus-like__LC101825
augaugauggccagcaaggacgccacccccuccgcggacggcgccaacggggccggccagcuggugccggaggucaacaacgccgagccccucccccuggaccccguggccggggcgagcaccgcccuggccacggccggccaggugaacaugaucgacccguggaucuucaacaacuucguccaggcgccccagggggaguucaccaucucccccaacaacacccccggcgacauccucuucgaccugcagcugggcccgcaccucaaccccuuccuggcccaccugagccagauguacaacgggugggugggcaacaugcgcgugcgggucauccucgccgggaacgccuucaccgccggcaaggugaucaucugcugcgugccgcccggguuccagucccgcacgcugagcaucgcgcaggccacccuguucccccacgucaucgccgacgugcggacccucgagccccuggagaucccccuggaggacgugcgcaacacccucuaccacaacaacgacucccagcccacgaugcggcugcugugcaugcucuacaccccgcugcgcaccggcggcgggagcggcgggaccgacgccuucgucguggccggccgggugcugacgugccccucccccgacuucaacuuccucuuccuggugcccccgaccgucgagcagaagacccgccccuucagcgugcccaacaucccccugcagaaccucuccaacagccgggucccgucccugauccagagcauggugcuguccagcgaccacgcgcagaccgugcaguuccagaacggccgcugcacgaccgacgggcaccuccugggcaccacccccgucuccagcgggcagcugaugaaguuccggggcaaggugacgcccggguccaaggugcucaaccugaccgagcuggacggcagccccuuccucgccuucgagccgcccgcccccgccggcuucccggaccuggggaagugcgacuggcacaucgagaugagccuguaccaggucaacaaccaggacaaccccaucgugcuccgcgccaucgagcccaacuccagcuccuucgucccccaccugggcagcguguccuucaaccagaacguggacgcggccggggacuacgucugcaccauccaguacaccagcccgcccuccaacagccacgacgccgacguggacuucugguccauccccgacuacggcagcaaccuggccgaggccucccagcucgcgcccguggucuacccgcccggguucggcgaggccaucguguacuucaugagccgggugcccggcuggaaccgcacgaaccggcugaaccugguccccugccuccugccgcaggaguucaucgggcacuucguguccgagcaggcccccgccaucggcgaggcggcccugcuccacuacguggaccccgacaccaaccgcaaccugggggaguucaagcuguaccccgagggcuucaucacgugcgucccgaacgggaccggcccccagcagcucccccugaacggcguguucguguucagcuccugggucagccgguucuaccagcugaagcccguggggaccgccuccagcgcccgcuga

SEQ ID NO: 12878 - RNA, 1605 nt, Artificial Sequence
  derived and/or modified sequence opt1 from VP1__Norovirus_and/or_Norovirus-like__AB081723
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgucggcuucccggaccugggcgggugcgacuggcacgugaacuucaccuuccaggcgcagaaccaggaccccagccaguccgugaccuucgccacgaacgacgccagcuucguccccuaccucggcuccaucagcccccacaacgggggcgacuuccacgccggggacaucaucggcucccugggcuggaucagcgccccguccgacaacacccagcugaacguguggaccauccccaaguacgggagcucccuccagaugagccugacccugcaccuccugugcagcccccggcugugggaggugauccucuacuucuacuccacguuccccggcuccgggcagccgagccagcugcagguccccugccugcucccccaggaguucaucacccacuucugcaacgagcaggcgcccaucgccggcgaggccgcccugcugcacuacguggacccggacaccgggcgcaaccucggcgaguucaagcuguaccccgacggcuucaugaccugcgugcccaacuccgucagcuccgggccccagacgcugccgaucaacggcguguucguguucgucagcugggugagccgguucuaccagcucaagcccguggggaccgcguccgccgcccgccggcuguga

SEQ ID NO: 12879 - RNA, 1605 nt, Artificial Sequence
  derived and/or modified sequence opt1 from VP1__Norovirus_and/or_Norovirus-like__JN005886
augaugauggccagcaaggacgcccccuccaacauggacggcaccagcggggcgggccagcuggugccggaggucaacgccgccgagccccucccccuggagcccguggugggggccgccaccgcggccgccacggccggccaggucaaccugaucgacccguggaucaugaacaacuucgugcaggcgcccgagggggaguucaccaucucccccaacaacacccccggcgacauccucuucgaccugcaccugggcccgcaccucaaccccuuccugcagcaccugagccagauguacaacgggugggugggcaacaugcgcguccgggugaugcucgccgggaacgccuucaccgccggcaagaucaucaucugcugcgugccgcccggguucgccucccagaacaucagcaucggccaggcgacgauguucccccacgucaucgccgacgugcgcgugcuggagcccaucgagaucccccuggacgacguccggaacguccucuuccacaccaacgagaaccgccccaccaugcggcugcugugcaugcucuacaccccgcugcgcgccggcggggccuccagcggcacggaccccuucgugaucgccgggcgggugcugaccugccccucccccgacuucaacuuccucuuccuggugccgcccagcguggagcagaagacccgccagcugaccguccccaacaucccccucaacaaccuggcgaacucccgggugccggccaugaucaacaagaugacggugagcaccgaccagaaccaggucgugcaguuccagaacggccgcugcacccuggagggccagcuccuggggaccacgcccguguccgccagccaggucgcccggauccgcggcaagguguucuccaccgccagcgggaagggccugaaccucaccgagcuggacgggacccccuaccacgcguucgagucccccgccccgcugggcuuccccgacaucggcgccugcgacuggcacgucagcacguucaagguggaccagaaccucuccggggaccccaugagccggcuggacgugaagcagaacgccccguucgcgccccaccugggcagcaucgaguucaccuccgaccaggaccccaccggggaccagcucggcacccuggcgugggucagccccuccacgagcggggcccgcguggacccguggaagauccccuccuacggcagcaccgugaccgaguccacccaccuggccccgcccaucuucccgcccggcuucggggaggccaucgucuacuucaugagcgacuuccccaucguguccggcaacacggcccaggugcccugcacccucccccaggaguucgucagccacuucguggagcagcaggcccccgugcgcggggaggccgcccugcugcacuacgucgaccccgacacccaccggaaccucggcgaguucaagcuguaccccgacggguucaucacgugcgugccgaacaccggcggcgggccccagaaccugcccaccaacggcguguucgucuucuccagcugggugucccgguacuaccagcucaagcccguggggaccgccggcccggcgcgccggcuguga

SEQ ID NO: 12880 - RNA, 1605 nt, Artificial Sequence
  derived and/or modified sequence opt1 from VP1__Norovirus_and/or_Norovirus-like__AB758449
augaugauggccagcaaggacgcccccuccaacauggacggcaccagcggggcgggccagcuggugccggaggucaacgccgccgagccccucccccuggagcccguggugggggccgccaccgcggccgccacggccggccaggucaaccugaucgacccguggaucaugaacaacuucgugcaggcgcccgagggggaguucaccaucucccccaacaacacccccggcgacauccucuucgaccugcagcugggcccgcaccucaaccccuuccugcagcaccugagccagauguacaacgggugggugggcaacaugcgcguccgggugaugcucgccgggaacgccuucaccgccggcaagaucaucaucugcugcgugccgcccggguucgccucccagaacaucagcaucggccaggcgacgauguucccccacgucaucgccgacgugcgcgugcuggagcccaucgagaucccccuggacgacguccggaacguccucuuccacaccaacgagaaccgccccaccaugcggcugcugugcaugcucuacaccccgcugcgcgccggcggggccuccagcggcacggaccccuucgugaucgccgggcgggugcugaccugccccucccccgacuucaacuuccucuuccuggugccgcccagcguggagcagaagacccgccagcugaccguccccaacaucccccucaacaaccuggcgaacucccgggugccggccaugaucaacaagaugacggugagcaccgaccagaaccaggucgugcaguuccagaacggccgcugcacccuggagggccagcuccuggggaccacgcccguguccgccagccaggucgcccggauccgcggcaagguguucuccaccgccagcgggaagggccugaaccucaccgagcuggacgggacccccuaccacgcguucgagucccccgccccgcugggcuuccccgacaucggcgccugcgacuggcacgucagcacguucaagguggaccagaaccucuccggggaccccaugagccggcuggacaucaagcagaacgccccguucgcgccccaccugggcagcaucgaguucaccuccgaccaggagcccaccggggaccagcucggcacccuggcgugggugagccccuccacgagcggggcccgcgucgacccguggaagauccccuccuacggcagcaccgugaccgaguccacccaccuggccccgcccaucuucccgcccggcuucggggaggccaucguguacuucaugagcgacuuccccaucgucuccggcaacacggcccaggugcccugcacccucccccaggaguucgugagccacuucgucgagcagcaggcccccauccgcggggaggccgcccugcugcacuacguggaccccgacacccaccggaaccucggcgaguucaagcuguaccccgacggguucaucacgugcgugccgaacaccggcggcgggccccagaaccugcccaucaacggcgucuucguguucuccagcugggugucccgguacuaccagcucaagcccgucgggaccgccggcccggcgcgccggcuguga

SEQ ID NO: 12881 - RNA, 1605 nt, Artificial Sequence
  derived and/or modified sequence opt1 from VP1__Norovirus_and/or_Norovirus-like__KX907729
augaugauggccagcaaggacgcccccuccaacauggacggcaccagcggggcgggccagcuggugccggaggucaacgccgccgagccccucccccuggagcccguggugggggccgccaccgcggucgccacggccggccaggugaaccugaucgacccguggaucaugaacaacuucgugcaggcccccgagggggaguucaccaucucccccaacaacacccccggcgacauccucuucgaccugcagcugggcccgcaccucaaccccuuccugcagcaccugagccagauguacaacgggugggucggcaacaugcgcgugcgggugaugcucgcggggaacgccuucaccgccggcaagaucaucaucugcugcgucccgcccggguucgccucccagaacaucagcaucggccaggccacgauguucccccacgugaucgcggacgugcgcguccuggagcccaucgagaucccccuggacgacgugcggaacguccucuuccacaccaacgagucccgccccaccaugcggcugcugugcaugcucuacaccccgcugcgcgccggcggggccagcuccggcacggaccccuucgugaucgccgggcgggugcugaccugccccagccccgacuucaacuuccucuuccuggugccgcccuccgucgagcagaagacccgccagcugaccgugcccaacaucccccucaacaaccuggccaacagccgggugccggcgaugaucaacaagaugacggucuccaccgaccagagccagguggugcaguuccagaacggccgcugcacccuggagggccagcuccuggggaccacgcccgucuccgccagccagguggcccggauccgcggcaaggucuucuccaccgccagcgggaagggccugaaccucaccgagcuggacgggacccccuaccacgccuucgagucccccgcgccgcugggcuuccccgacaucggcgccugcgacuggcacgugagcacguucaagguggaccagaaccucagcggggaccccaugucccggcuggacaucaagcagaacgccccguucgcgccccaccugggcagcaucgaguucaccuccgaccaggagcccaccggggaccagcucggcacccuggccugggucagccccuccacgagcggggcccgcguggacccguggaagauccccuccuacggcagcaccgugaccgaguccacccaccuggccccgcccaucuucccgcccggcuucggggaggccaucgucuacuucaugagcgacuuccccaucguguccggcaacacggcccaggugcccugcacccucccccaggaguucgucagccacuucguggagcagcaggcgcccauccgcggggaggccgcccugcugcacuacguggaccccgacacccaccggaaccucggcgaguucaagcuguaccccgacggguucaucacgugcgucccgaacaccggcggcgggccccagaaccugcccaucaacggcguguucguguucuccagcugggucucccgguacuaccagcucaagcccguggggaccgccggcccggcccgccggcuguga

SEQ ID NO: 12882 - RNA, 1602 nt, Artificial Sequence
  derived and/or modified sequence opt1 from VP1__Norovirus_and/or_Norovirus-like__JN899243
augaugauggccagcaaggacgcccccuccaacauggacggcaccagcggggcgggccagcuggugccggaggucaacaccgccgagccccucccccuggagcccguggugggggccgccacggccgcggccaccgccggccaggucaaccugaucgacccguggaucaugaacaacuucgugcaggcccccgagggggaguucaccaucucccccaacaacacccccggcgacauccucuucgaccugcgccugggcccgcaccucaaccccuuccugcugcaccucagccagauguacaacgggugggugggcaacaugcggauccgcgucaugcuggcggggaacgccuucuccgccggcaagaucaucaucugcugcgugccgcccggguucgagagccagaacaucuccaucggccaggccacgauguucccccacgugaucgccgacguccgggugcuggagcccaucgagaucccccucgacgacgugcgcaacguccuguaccacaccaacgagaaccggcccaccaugcgccugcucugcaugcuguacaccccgcugcgggcgggcggggccagcuccggcacggaccccuucgugaucgccgggcgcgugcugaccugccccgcccccgacuucaacuuccucuuccuggucccgcccagcguggagcagaagacccggcagcucaccauccccaacaucccccugaacaaccuggccaacucccgcgugccggcgaugaucaacaagauggccgucagcgccgaccagaaccagguggugcaguuccagaacggccggugcacgcucgagggccagcugcuggggaccacccccgucuccgccaaccagguggcccgcauccggggcaagguguucagcaccaacuccgggacgggccucaaccugaccgagaccgacgggacccccuaccacgcguucgagagccccgccccgcugggcuuccccgacaucggcgacugcgacuggcacgucuacgccuucaaggugaaccagaacacgggggaccccauguaccgccucgacaucacccagggcaacuccuucgccccgcaccuggggagcaucgaguucaccuccgaccagcaccccagcggcgaccagcuggggacccucacguggaucagcccccugaacaacgccucccgggucgaccccuggaagaucccgagcuacggcuccacccugaccgagagcaccaaccucgcgccgcccaucuucccgcccggcuucggggaggccaucguguacuucauguccgacuuccccaucgugagcggcaacacgacccagauccccugcacccugccccaggaguucaucuccagcuucgucgagcagcaggcccccauccgcggggaggccgcgcugcuccacuacguggaccccgacacccaccggaaccugggcgaguucaagcuguaccccgacggguucaucacgugcgugcccaacaccggcggcgggccgcagaaccuccccuccaacggcgucuucaucuucagcuccugggugagccgcuacuaccagcugaagcccguggggaccgccggccccgcccggcgccuguga

SEQ ID NO: 12883 - RNA, 1602 nt, Artificial Sequence
  derived and/or modified sequence opt1 from VP1__Norovirus_and/or_Norovirus-like__AB810004
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaaccgcggggacaacugggaccagaaccugcugcagcucaccuaccccagcggcgccuccuacgacccgaccgacgaggugcccgcgccccugggcacgcaggacuucagcgggauccuguacggcgugcucacccaggacaacgucagcgaggggaccggcgaggccaagaacgccaaggggguguacaucuccaccacgagcggcaaguucacccccaagaucggcuccaucgggcugcacagcaucaccgagaacguccacccgaaccagcagucccgguucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccgcagccgggugcccugcguccaggggcugcgcggccaggacgcguucaucgacugccuccugccgcaggagugggugaaccacuucuaccaggaggccgcccccucccaggccgacguggcccugauccgguacgucaaccccgacaccggccgcacccucuucgaggcgaagcugcaccggagcggguucaucacggugucccacaccggcgccuacccccugguggucccgcccaacgggcacuuccgcuucgacagcugggugaaccaguucuacucccucgcccccaugggcuga

SEQ ID NO: 12884 - RNA, 1602 nt, Artificial Sequence
  derived and/or modified sequence opt1 from VP1__Norovirus_and/or_Norovirus-like__JN183163
augaugauggccagcaaggacgccacccccuccgcggacggcgccaccggggccggccagcuggugccggaggucaacacggccgaccccauccccaucgaccccguggccgggagcuccaccgcgcucgccaccgccggccaggugaaccugaucgacccguggaucaucaacaacuucguccaggcgccccagggggaguucaccaucagccccaacaacacgcccggcgacgugcuguucgaccuccagcugggcccgcaccugaaccccuuccucucccaccugagccagauguacaacgggugggugggcaacaugcgcguccggguggugcuggccgggaacgccuucaccgccggcaaggucaucaucugcugcgugccgcccggguuccagucccgcacccucagcaucgcccaggccacccuguucccccacgugaucgcggacguccggacgcuggaccccguggaggugccccucgaggacguccgcaacgugcuguaccacaacaacgacacccagcccaccaugcggcugcucugcaugcuguacaccccgcugcgcacgggcggcgccuccgggggcaccgacagcuucguggucgccgggcgggugcugaccugccccggccccgacuucaacuuccucuuccuggugcccccgaccgucgagcagaagacgcgccccuucaccgugcccaacaucccccucaaguaccuguccaacagccggaucccgaaccccaucgagggcaugucccugagccccgaccagacccagaacgugcaguuccagaacgggcgcugcaccaucgacggccagccccucgggacgaccccggucuccgugagccagcugugcaaguuccggggccgcaucaccuccgggcagcggguccugaaccucaccgagcuggacggcagccccuucauggccuucgccgcgcccgccccggccggcuuccccgaccugggguccugcgacuggcacaucgagaugagcaagauccccaacagcuccacgcagaacaaccccaucguggugaacagcgucaagccgaacucccagcaguucgugccccaccucagcuccaucacccuggacgacaacgugagcuccggcggggacuacaucggcaccauccaguggaccagcccgcccuccgacagcgggggcgccaacacgaacuucuggaagauccccgacuacggcuccagccuggccgaggcgucccagcucgcccccgccgucuacccgcccggguucaacgaggugaucguguacuucauggccagcauccccggccccaaccaguccgggagccccaaccugguccccugccugcucccgcaggaguacaucacccacuucaucuccgagcaggcccccauccagggcgaggcggcccugcugcacuacguggaccccgacaccaaccgcaaccucggggaguucaagcuguaccccggcggcuaccugaccugcgugccgaacagcuccagcacggggccccagcagcucccccuggacggcgucuucguguucgccagcugggugucccgguucuaccagcugaagcccgucgggaccgccuga

SEQ ID NO: 12885 - RNA, 1599 nt, Artificial Sequence
  derived and/or modified sequence opt1 from VP1__Norovirus_and/or_Norovirus-like__EU373815
augaagauggccagcaacgacgccucccccagcuccgacggcagcgcgaaccuggugccggagaucaacaacgaggucauggcccucgagcccguggccggggccgccaucgcggcccccguggccggccagcagaacaucaucgaccccuggauccgcaacaacuucguccaggcccccgggggcgaguucaccgugagcccccggaacgcgcccggggaggugcugcugaaccucccccuguccccggacaucaaccccuaccuggcccaccucucccgcauguacaacggcuacgccggcggggucgagguggaggugguccuggccggcaacgccuucaccgcggggaagaucaucuucgccgccgugccgcccaacuucccgcccgagaaccugagccccucccagaucacgaugcucccccacaucaucguggacguccggcagcuggagccggugcgcaucccccugcccgacgugcggaacaacuucuaccacuacagccgcgagaacgacuccacccuccggcuggucgccaugcuguacacgccccuccgcgccaacaacgcgggcgacgacguguucaccgugagcugccggguccugacccgcccgucccccgacuucgacuucaucuuccuggugccgcccaccguggagagcaaguccaagcccuucaccauccccauccucaccaucgaggagaugacgaacagccgguuccccgcgccccuggagaugaugaccaccgggccgucccacgacaucgucgugcagccccagaacggccgcugcaccaucgacggcgugcugcucgggacgacccagcugagccccgucaacaucugcuccaugcggggcgugccgaccaagcgcaccaacgggacggacaacugcuucguccagcuggagaaccccaacggcagcgccuacgaccccaccgaggacauccccgccgugcucggcagcccggacuucgugggggaguucuacggcaccaucacccagcggucccccaacaacagcacgcgcgcccaccccuucacccugaacaccgggagcccccgguacaccccgaagaucggcuccgucgacauccacgugacggacguggacgaccugaacgaccacgagcccgucaagcucacccccguggggcuguccggcagcuccggcagcauccaccaguggcagcugcccaacuacuccgggguggccacccacaacaugcaccucgccccgagcgucgcgccccuguuccccggcgagcagauccuguucuuccgcuccaccgugcccgggugcggcggguacccgaacacgaacaucgacugccucaucccccaggagugggugcagcacuucuaccaggagggcgcccccgcccggaccgacgucgcccugcugcgcuucaucaaccccgacaccggccggguccucuucgagugcaagcugcacaagcacggguucaucaccguggccuacagcggcaaccacgaccuggugaugccgcccaacggguacuuccgcuucgaguccugggugaaccaguuccacacgcucgcccccaugggcaccgggcgcgccgaggaguga

SEQ ID NO: 12886 - RNA, 1599 nt, Artificial Sequence
  derived and/or modified sequence opt1 from VP1__Norovirus_and/or_Norovirus-like__KC473547
auggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgucggcuucccggaccugggcgggugcgacuggcacgugaacuucagcuuccagacccaggaccgggaccccucccagagcgugaccuucgcgacgaacgacgccuccuucguccccuaccucggcagcgugagcccccacaacggggagggcuuccaggccggggacaucaucggcucccugggcuggaucuccgccccgagcgacaacucccaguucaacgugugggccauccccaaguacgggagcucccugcagaugagccccauccuccugcugcucugcagcccccgccugugggaggucauccuguacuucuacuccaccuucccgggcuccgggcagcccagccagcuccaggugcccugccugcugccccaggaguucaucacccacuucugcaacgagcaggcgccgaucgccggcgaggccgcccuccugcacuacguggaccccgacaccgggcggaaccugggcgaguucaagcucuaccccgacggcuucaugacgugcguccccaacuccgugagcagcgggccgcagacccugcccaucaacggcguguucgucuucguguccugggugagccgcuucuaccagcugaagcccgucgggaccgcguccgccgcccggcgccucuga

SEQ ID NO: 12887 - RNA, 1599 nt, Artificial Sequence
  derived and/or modified sequence opt1 from VP1__Norovirus_and/or_Norovirus-like__GQ266692
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggaagauccagggcguccucacccagaccacgcggcgggacgggagcacccgcggccacaaggccaccgugagcaccggguccgugcaguucacgccgaagcugggccggauccaguucagcaccgacaccuccaacgacuucgagaccggccagaacacgcgcuucacccccgucgggguggugcaggacggcagcaccacccaccagaacgagccccagcaguggguccugcccaacuacuccgggcgggacagccacaacgugcaccucgccccggccguggcccccuccuuccccggcgagcagcugcuguucuuccgcagcacgaugcccgggugcuccggcuacccgaacaugaaccucgacugccugcugccccaggaguggguccagcacuucuaccaggaggccgcgcccgcccagagcgacguggcccuccugcgguucgugaaccccgacaccggccgcguccuguucgagugcaagcuccacaaguccggguacgugaccguggcccacaccggccagcacgaccuggucaucccgcccaacggguacuuccgguucgacagcugggugaaccaguucuacacccuggcguccauggccacguga

SEQ ID NO: 12888 - RNA, 1599 nt, Artificial Sequence
  derived and/or modified sequence opt1 from VP1__Norovirus_and/or_Norovirus-like__GQ266693
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacagcuacgccggcggguucgaggugcaggucauccucgccggcaacgccuucacggcggggaagaucaucuucgccgccgugccgcccaacuucccgaccgagggccugucccccagccaggugaccauguucccccacaucaucgucgacgugcggcagcuggagcccgugcucaucccgcugcccgacguccgcaacaacuucuaccacuacaaccaguccaacgaccccaccaucaagcugaucgccaugcucuacacgccccugcgggccaacaacgcgggggacgacguguucaccgugagcugccgcguccugacccggccgucccccgacuucgacuucaucuuccucgugccgcccaccguggagagccgcacgaagcccuucuccguccccauccugaccguggaggagaugaccaacagccgguuccccaucccccuggagaagcuguucaccggcccguccagcacguucgugguccagccccagaacggccgcugcaccaccgacggggugcuccugggcaccacgcagcucucccccgucaacaucugcaccuuccgcggggacgugacccacaucgccagcacccggguguacacgaugaaccuggccucccagaacuggaacaacuacgacccgaccgaggagauccccgcgccccugggcacccccgacuucgucggcaagauccagggggugcucacccagacgacccggggcgacgggagcacccgcggccacaaggccaccgugagcacgggguccgucgaguucaccccgaagcugggccggauccaguucagcaccgacaccuccaacgacuucgagacgggccagaacacccgcuucacccccgugggggugauccaggacggcaacaccacgcaccagaacgagccccagcagugggcccugcccaacuacagcggguccggcagccacaacguccaccucgccccggccguggcccccuccuuccccggggagcagcugcuguucuuccggagcaccaugcccggcugcuccggcuacccgaacaugaaccucgagugccugcugccccaggagugggugcagcacuucuaccaggaggccgcgcccgcccagagcgacgucgcccuccugcgcuucgugaaccccgacaccgggcgggugcuguucgagugcaagcuccacaaguccggcuacgucaccguggcccacaccgggcagcacgaccuggugaucccgcccaacggcuacuuccgcuucgacagcuggaucaaccaguucuacacgcuggcguccauggccaccuga

SEQ ID NO: 12889 - RNA, 1599 nt, Artificial Sequence
  derived and/or modified sequence opt1 from VP1__Norovirus_and/or_Norovirus-like__EU004673
augcgcaugagcgacggcgccgcccccaaggcguccgggagcgaggccuccggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucagcaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcucccugaccaccgcccagaucacgugcuucccccacgugaugugcgacguccgcacccucgagcccauccagcugccccugcucgacgugcggcgcgugcuguggcacgcgacccaggaccaggaggagagcaugcggcuggucugcaugcucuacaccccgcugcgcacgaacucccccggcgacgagagcuucgugguguccgggcggcugcucagcaagcccgccgccgacuucaacuucgucuaccugacgcccccgaucgagcgcaccaucuaccggaugguggaccugcccgugcuccagccccgccugugcacccacgcccgguggcccgccccggucuacggccugcucguggaccccucccugcccagcaacccccaguggcagaacgggcgcgugcacaucgacggcacccugcucggcaccaccccggucuccgggagcuggguguccugcuucgcggccgaggccgccuacgaguuccagagcggcaccggggaggucgccacguucacccugaucgagcaggacggcuccgcguacgugcccggggaccgggccgcgccccugggcuacccggacuucagcggccagcucgagaucgaggugcagaccgagaccacgcgcgccggggacaagcugaaggucaccaccuucgagaugauccugggccccaccacgaacguggaccaggcccccuaccaggggcggguguacgccagccucaccgccgccgccucccuggaccuggucgacggccgcgugcgggcggugccccgcagcaucuacuccuuccaggacguccucccggaguacaacgacgggcugcuggugccccucgccccgcccaucggccccuuccugcccggcgaggugcugcuccgguuccgcaccuacaugcggcaggucgacagcuccgacgccgccgccgaggcgaucgacugcgcccugccccaggaguucgugagcugguucgccuccaacggguucaccgugcagagcgaggcccugcuccugcgcuaccgcaacacgcugaccggccagcuccuguucgagugcaagcuguacuccgagggguacaucgcccugagcuacuccggcagcgggccccucaccuucccgaccgacggcuucuucgaggucguguccugggugccccggcuguuccagcuggcgagcgucggcuccuga

SEQ ID NO: 12890 - RNA, 1599 nt, Artificial Sequence
  derived and/or modified sequence opt1 from VP1__Norovirus_and/or_Norovirus-like__AB601769
augcgcaugagcgacggcgccgcccccaaggcgaacggguccgaggccagcggccaggaccuggugcucaccgccgucgagcaggccgugccgauccagcccguggccggggcggcccuggccgcccccgcggccggccagaucaaccagaucgaccccuggaucuuccagaacuucguccagugcccgcugggggaguucuccaucagcccccggaacacccccggcgagauccucuucgaccuggcccugggccccgggcucaacccguaccuggcccaccuguccgccauguacacgggcuggguggggaacauggaggugcagcucguccuggcgggcaacgccuucaccgccgggaaggugguggucgcccuggugccgcccuacuuccccaagggcagccucaccaccgcccagaucacgugcuucccccacgugaugugcgacguccgcacccuggagcccauccagcugccccuccuggacgugcggcgcgugcuguggcacgcgacccaggaccaggaggaguccaugcggcucgucugcaugcuguacacgccccugcgcaccaacagcccgggcgacgaguccuucguggugagcgggcggcuccuguccaagcccgccgccgacuucaacuucgucuaccugaccccgcccaucgagcgcaccaucuaccggaugguggaccuccccgugcugcagccccgccugugcacccacgcccgguggcccgcccccgucuacggccuccugguggacccgagccugcccuccaacccccaguggcagaacgggcgcgugcacgucgacggcacgcuccugggcaccacccccgugagcggguccugggucagcugcuucgcggccgaggccgccuacgaguuccaguccggcaccggggagguggccacguucacccugaucgagcaggacggcagcgcguacgugccgggggagcgggccgcgccccucggcuaccccgacuucuccggccagcuggagaucgagguccagaccgagaccacgaagcgcggggagaagcugaaggugaccaccuucgagaugauccucggcccgaccacgaacguggaccaggcccccuaccaggggcgggucuacgccagccugagcgccgccgccucccuggaccucguggacggccgcgugcgggccgucccccgcagcaucuacggguuccaggacgugauccccgaguacaacgacggccugcuggugccgcucgcgccgcccaucggccccuuccugcccggggagguccugcuccgguuccgcaccuacaugcgccagguggacuccagcgacgccgccgccgaggccaucgacugcgcgcugccccaggaguucguguccugguucgccagcaacggcuucaccguccaguccgaggcccugcuccugcgguaccgcaacacccugacggggcagcuccuguucgagugcaagcuguacagcgagggcuacaucgcccuguccuacagcggguccggcccccucaccuuccccaccgacggcuucuucgagguggugagcugggucccgcggcuguaccagcuggccuccguggggagcuga

SEQ ID NO: 12891 - RNA, 1599 nt, Artificial Sequence
  derived and/or modified sequence opt1 from VP1__Norovirus_and/or_Norovirus-like__EU004676
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgcccccgacuucaacuucgucuaccugaccccgcccaucgagcgcaccaucuaccggaugguggaccugcccgugcuccagccccgccugugcacccacgcccgguggccggcccccgucuacggccugcucguggaccccagccugcccuccaacccgcaguggcagaacgggcgcgugcaggucgacggcacgcugcucggcaccacccccgugagcggguccugggucagcugcuucgccgcggaggccgccuacgaguuccaggccggcaccggggagguggugacguucaccaugaucgagcaggacggcuccgccuacguccccggggaccgggcggccccgcugggcuaccccgacuucagcggccagcuggagaucgaggugcagaccgagaccacgaagaccggggacaagcuccgcgugaccaccuucgagaugauccugggccccacgaccaacgucgaccaggcccccuaccaggggcgggccuacgcgucccugaccgccgccgccagccucgaccugguggacggccgcgugcgggccgucccgcgcagcaucuacuccuuccaggacgagcugcccgaguacaacgacgggcuccuggugccccuggcgcccccgcucggccccuuccugcccggcgaggugcugcuccgguuccgcaccuacaugcggcagcuggacacggccgacgccgccgcccagcccaucgacugcgcgcugccgcaggaguucaucagcugguucgccuccaacaacuucaccguccagagcgacgcccuccuggugcgcuaccgcaacacccugaccgggcagcuccucuucgaggccaagcuguacuccgagggcuacaucgccgugagcuacuccgggagcggcccccugacguuccccaccgacggguucuucgaggucguguccugggugccccggcuguuccagcuggcgagcgucggcuccuga

SEQ ID NO: 12892 - RNA, 1599 nt, Artificial Sequence
  derived and/or modified sequence opt1 from VP1__Norovirus_and/or_Norovirus-like__JQ237823
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgcccccgacuucaacuucgucuaccugaccccgcccaucgagcgcaccaucuaccggaugguggaccugcccgugcuccagccccgccugugcacccacgcccgguggccggcccccgucuacggccugcucguggaccccagccugcccuccaacccgcaguggcagaacgggcgcgugcaggucgacggcacgcugcucggcaccacccccgugagcggguccugggucagcugcuucgccgcggaggccgccuacgaguuccaggccggcaccggggagguggugacguucaccaugaucgagcaggacggcuccgccuacguccccggggaccgggcggccccgcugggcuaccccgacuucagcggccagcuggagaucgaggugcagaccgagaccacgaagaccggggacaagcuccgcgugaccaccuucgagaugauccugggccccacgaccaacgucgaccaggcccccuaccaggggcgggccuacgcgucccugaccgccgccgccagccucgaccugguggacggccgcgugcgggccgucccgcgcagcaucuacuccuuccaggacgagcugcccgaguacaacgacggggugcucgugccccuggcgcccccgcugggccccuuccuccccggcgagguccugcugcgguuccgcaccuacaugcggcagcucgacacggccgacgccgccgcccagcccaucgacugcgcgcugccgcaggaguucaucagcugguucgccuccaacaacuucaccgugcagagcgacgcccugcucgugcgcuaccgcaacacccugaccgggcagcugcuguucgaggccaagcucuacuccgagggcuacaucgccgucagcuacuccgggagcggcccccugacguuccccaccgacggguucuucgaggugguguccugggucccccggcuguuccagcucgcgagcgugggcuccuga

SEQ ID NO: 12893 - RNA, 1599 nt, Artificial Sequence
  derived and/or modified sequence opt1 from VP1__Norovirus_and/or_Norovirus-like__DQ223043
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcacccucgagcccauccagcugccccugcucgacgugcggcgcgugcuguggcacgcgacccaggaccaggaggaguccaugcggcuggucugcaugcucuacaccccgcugcgcacgaacagccccggcgacgaguccuucguggugagcgggcggcugcucuccaagcccgccagcgacuucaacuucgucuaccugacgcccccgaucgagcgcaccaucuaccggaugguggaccugcccgugcuccagccccgccugugcacccacgcccgguggcccgccccggucuacggccugcucguggaccccucccugcccagcaacccccaguggcagaacgggcgcgugcacgucgacggcacccugcucggcaccaccccgguguccgggagcugggucuccugcuucgccgcggaggccgccuacgaguuccagagcggcaccggggagguggccacguucaccaugaucgagcaggacggcuccgccuacgugcccggggaccgggcggcgccccugggcuacccggacuucagcggccagcuggagaucgagguccagaccgagaccacgaagaccggggacaagcucaaggugaccaccuucgagaugauccugggccccacgaccaacguggaccaggcccccuaccaggggcgcgccuacgccagccugaccgccgccgccucccucgaccuggucgacggccgggugcgcgccgugccccggagcgucuacuccuuccaggacgagcugccggaguacaacgacgggcuccuggugccccuggcgccgccccucggccccuuccugcccggcgaggugcugcuccgcuuccggaccuacaugcgccagcuggacacggccgacgccagcgcccagcccaucgacugcgcccugccccaggaguucaucuccugguucgcgagcaacaacuucaccguccaguccgacgcccuccuggugcgguaccgcaacacccugaccgggcagcuccuguucgaggccaagcuguacagcgagggcuacaucgccguguccuacagcggguccggcccgcugacguuccccaccgacggguucuucgaggucgugagcugggugccccgccucuuccagcuggccuccgucggcagcuga

SEQ ID NO: 12894 - RNA, 1599 nt, Artificial Sequence
  derived and/or modified sequence opt1 from VP1__Norovirus_and/or_Norovirus-like__JX048594
augcgcaugagcgacggcgccgcccccaaggcgaacggguccgaggccagcggccaggaccuggugccgaccgccgucgagcaggccgugcccauccagcccguggccggggcggcccucgccgcccccgcggccggccagaucaaccagaucgacccguggaucuuccagaacuucguccagugcccccugggggaguucuccaucagcccccggaacacccccggcgagauccuguucgaccucgcccugggcccggggcugaaccccuaccucgcccaccuguccgccauguacacgggcuggguggggaacauggaggugcagcugguccucgcgggcaacgccuucaccgccgggaaggugguggucgcccuggugccgcccuacuuccccaagggcagccugaccaccgcccagaucacgugcuucccccacgugaugugcgacguccgcgcgcucgagcccauccagcugccccugcucgacgugcggcgcgugcuguggcacgccacccaggaccaggaggaguccaugcggcuggucugcaugcucuacaccccgcugcgcaccaacagccccggcgacgaguccuucguggugagcgggcggcugcucuccaagcccgccgccgacuucaacuucgucuaccugacgcccccgaucgagcgcaccaucuaccggaugguggaccugcccgugcuccagccccgccugugcacccacgcccgguggcccgcgccggucuacggccugcucguggaccccagccugcccuccaacccccaguggcagaacgggcgcgugcacgucgacggcacccugcucggcacgaccccggugagcggguccugggucagcugcuucgccgccgaggccgccuacgaguaccaguccgaggugggcgagguggcgaccuucacccugaucgagcaggacgggagcgccuacguccccggcgaccgggccgcgccccugggguacccggacuacuccggccagcucgagaucgaggugcagacggagaccaccaagaccggcgacaagcugaaggugacgaccuucgacaugauccuggggcccaccaccaacgucgaccaggugcccuaccagggcaagguguacgccagccucacgaccgccagcucccuggaccuggucgacgggcgcgcccgggccgugccccgcagcguguacuccuuccaggacguccucccggaguacaacgacggccugcuggugccccucgccccgccccuggggcccuaccugcccggcgaggugcuccugcgguuccgcaccuacaugcggcagcuggacaccgcggacgccgccgcccagcccaucgacugcgcccucccccaggaguucaucagcugguucgcguccaacaacuucacgguccagagcgacgcccugcugauccgcuaccggaacacccugaccggccagcuccuguucgaggccaagcuguacuccgagggguacaucgccgugagcuacuccggcagcgggccgcucaccuuccccacggacggcuucuucgagguggucuccugggugccccgccuguuccagcuggccagcgugggguccuga

SEQ ID NO: 12895 - RNA, 1596 nt, Artificial Sequence
  derived and/or modified sequence opt1 from VP1__Norovirus_and/or_Norovirus-like__GQ266691
augaagauggccagcuccgacgccaaccccagcgacggcuccaccgcgagccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucagcguccccauccugaccaucgaggagaugaccaacucccgguuccccaucccccuggagaagcuguucaccggcccgagcuccgccuucguggugcagccccagaacgggcgcugcacgaucgacggcguccuccuggggaccacccagcucagccccgugaacaucugcaccuuccggggcgacgucacgcacaucgagggcuccaagguguacaccaugaaccuggccagccagaacuggaacaacuacgacccgaccgaggagauccccgcgccccuggggacccccgacuucaagggccgcauccagggggugcucacgcagaccacccggagcgacggcuccacccgcgggcacacggccaccgucagcaccggcuccgccgaguucaccccgaagcugggccggauccaguucagcacggacaccaacaacgacuucgagaccgggcagaacaccaaguucacgcccgugggcgugguccagaacggguccaccacccaccagaacgagccccagcagugggagcugcccgacuacagcggccgcgggauccacaacgugcaccucgccccggccguggcccccaccuaccccggcgagcagauccuguucuuccgguccacgaugcccggcugcagcggguacccgaacaugaaccuggacugccuccugccccaggacuggguccgccacuucuaccaggaggccgcgcccgcccaguccgacguggcccugcuccgguucgugaaccccgacaccggccgcguccuguucgagugcaagcugcacaagagcggguacgugaccguggcccacaccggccagcacgaccucgucaucccgcccaacggguacuuccgguucgacuccugggugaaccaguucuacacccuggcgcccaugggcuga

SEQ ID NO: 12896 - RNA, 1596 nt, Artificial Sequence
  derived and/or modified sequence opt1 from VP1__Norovirus_and/or_Norovirus-like__GQ266690
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacuccuacgccggcggguucgaggugcaggucauccucgccggcaacgccuucacggcggggaagaucaucuucgccgccgugccgcccaacuucccgaccgagggccugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggggacgacguguucaccguguccugccgcguccugacccggccgagccccgacuucgacuucaucuuccucgugccgcccaccguggagucccgcacgaagcccuucagcguccccauccugaccguggaggagaugaccaacucccgguuccccaucccccuggagaagcuguucaccggcccgagcuccgccuucgugguccagccccagaacggccgcugcacgaccgacggggugcuccugggcaccacccagcucagccccgucaacaucugcacguuccgcggggacgugacccacaucgccggcacccaggaguacaccaugaaccuggccucccagaacuggaacaacuacgacccgacggaggagauccccgcgccccugggcacccccgacuucguggggcggauccagggcguccucacccagaccacgcggcgcgacgggagcacccggggccacaaggccaccgugagcaccggguccgugcacuucacgccgaagcugggccgcauccaguucagcaccgacaccuccaacgacuucgagaccggccagaacacgcgguucacccccgucgggguggugcaggacggcgggaccacccaccagaacgagccccagcaguggguccugcccaacuacagcggccgcgacgggcacaacgugcaccucgccccggccguggcccccuccuuccccggcgagcagauccuguucuuccggagcacgaugcccggcugcuccggguacccgaacaugaaccuggacugccuccugccccaggaguggguccagcacuucuaccaggaggccgcgcccgcccagagcgacguggcccugcuccgcuucgugaaccccgacaccggccggguccuguucgagugcaagcugcacaaguccggguacgugaccguggcccacaccggccagcacgaccucgucaucccgcccaacggguacuuccgcuucgacagcugggugaaccaguucuacacccuggcgcccaugggcuga

SEQ ID NO: 12897 - RNA, 1596 nt, Artificial Sequence
  derived and/or modified sequence opt1 from VP1__Norovirus_and/or_Norovirus-like__JN183164
augaugauggccagcaaggacgcccccaccaacauggacggcaccuccggggcgggccagcuggugccggaggucagcacggccgagcccaucuccauggagcccguggccggggccgccaccgcggccgccaccgccggccaggugaacaugaucgaccccuggaucaugagcaacuacguccaggcgccgcagggggaguucaccaucucccccaacaacacgcccggcgacauccucuucgaccugcagcugggcccccaccucaacccguuccugagccaccuggcccagauguacaacgggugggugggcaacaugaaggugcgcguccuccuggccgggaacgccuucaccgccggcaagaucaucaucuccugcgugccgcccggguucgcggcccagaacgugagcaucgcccaggccaccauguucccccacgucaucgccgacgugcgggugcuggagcccaucgaggucccccucgaggacgugcgcaacgugcuguuccacaacaacgacuccacccccacgaugcggcugaucugcaugcucuacacgccccugcgcgcgagcggcuccagcuccggcaccgacccguucgucaucgccgggcgggugcugaccugccccagccccgacuucaacuuccucuuccuggugcccccgaacgucgagcagaagaccaagcccuucuccgugcccaaccugccccucaacgugcugagcaacucccgcgucccgagccugaucaaguccaugauggugagccaggaccacggccagauggugcaguuccagaacgggcgggucacccucgacggccagcugcagggcaccacccccacgagcgccucccagcugugcaagauccgcgggaccguguaccacgccaccggcgggcagggccucaaccugaccgagaucgacgggacgcccuaccacgccuucgagagccccgcgccgaucggcuuccccgaccugggcgagugcgacuggcacaucaacgccucccccgccaacgccuucaccgacgggagcaucauccaccggaucgacgucgcccaggacuccaccuucgcgccgcaccucggcaccauccacuacacgaacgccgacuacaacgccaacguggggcugaucugcagccuggaguggcucuccccgcccagcggcggggcccccaaggugaaccccugggcgaucccccgcuacggcuccacccugaccgaggccgcccagcuggccccgcccaucuacccgcccggcuucggggaggccaucgucuucuucaugagcgacuuccccaucgcgaacggcuccgacgggcucagcgugcccugcaccaucccccaggaguucgugacgcacuucgucaacgagcaggcccccacccggggcgaggccgcccugcugcacuacguggaccccgacacccaccgcaaccucggggaguucaagcuguaccccgagggcuucaugaccugcgugccgaacuccagcggcuccgggccccagacgcugcccaucaacggcgucuucaccuucaucagcugggugucccgguucuaccagcucaagcccguggggaccuga

SEQ ID NO: 12898 - RNA, 1596 nt, Artificial Sequence
  derived and/or modified sequence opt1 from VP1__Norovirus_and/or_Norovirus-like__AB809995
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcggggccaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggguucaucacggugagccacaccggcgccuacccccugguggucccgcccaacgggcacuuccgguucgacuccugggugaaccaguucuacagccucgcccccuga

SEQ ID NO: 12899 - RNA, 1593 nt, Artificial Sequence
  derived and/or modified sequence opt1 from VP1__Norovirus_and/or_Norovirus-like__KT732275
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacacggggcgcacccucuucgaggcgaagcugcaccgcuccggcuacaucaccguggcccacagcggggacuacccccuggugguccccgccaacggccacuuccgguucgacuccugggugaaccaguucuacagccucgcccccauguga

SEQ ID NO: 12900 - RNA, 1593 nt, Artificial Sequence
  derived and/or modified sequence opt1 from VP1__Norovirus_and/or_Norovirus-like__AB809998
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggccaccggggaggccaagaacgccaagggcguguacaucagcaccacguccgggaaguucacccccaagaucggcagcaucggccugcacuccaucaccgagaacguccacccgaaccagcagagccgcuucacccccguggggguggcccagaacgagaacacgcccuuccagcaguggguccugccccacuacgccggcgcgcucgcccugaacaccaaccuggccccggccguggcgcccaccuuccccggggagcagcuccuguucuuccggucccgcgugcccugcguccagggccugcgggggcgcgacgccuucaucgacugccuccugccgcaggagugggugaaccacuucuaccaggaggccgcccccagccaggccgacguggcgcugauccgguacgucaaccccgacaccggccgcacccucuucgaggccaagcugcaccgguccggcuucaucacggugagccacaccggggccuacccccugguggucccgcccaacggccacuuccgcuucgacuccugggugaaccaguucuacagccucgccuga

SEQ ID NO: 12901 - RNA, 1593 nt, Artificial Sequence
  derived and/or modified sequence opt1 from VP1__Norovirus_and/or_Norovirus-like__AB809984
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcggggccaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggguucaucacggugagccacaccggcgccuacccccugguggucccgcccaacgggcacuuccgguucgacuccugggugaaccaguucuacagccucgccuga

SEQ ID NO: 12902 - RNA, 1590 nt, Artificial Sequence
  derived and/or modified sequence opt1 from VP1__Norovirus_and/or_Norovirus-like__KT732276
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacacggggcgcacccucuucgaggcgaagcugcaccgcuccggcuacaucaccguggcccacagcggggacuacccccuggugguccccgccaacggccacuuccgguucgacuccugggugaaccaguucuacagccucgcccccuga

SEQ ID NO: 12903 - RNA, 1590 nt, Artificial Sequence
  derived and/or modified sequence opt1 from VP1__Norovirus_and/or_Norovirus-like__AB810009
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaaccgcggggacaacugggaccagaaccugcugcagcucaccuaccccagcggcgccuccuacgacccgaccgacgaggugcccgcgccccugggcacgcaggacuucagcgggauccuguacggcgugcucacccaggacaacgucagcgaggggaccggcgaggccaagaacgccaaggggguguacaucuccaccacgagcggcaaguucacccccaagaucggcuccaucgggcugcacagcaucaccgagaacguccacccgaaccagcagucccgguucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccgcagccgggugcccugcguccaggggcugcgcggccaggacgcguucaucgacugccuccugccgcaggagugggugaaccacuucuaccaggaggccgcccccucccaggccgacguggcccugauccgguacgucaaccccgacaccggccgcacccucuucgaggcgaagcugcaccggagcggguucaucacggugucccacaccggcgccuacccccugguggucccgcccaacgggcacuuccgcuucgacagcugggugaaccaguucuacucccucuga

SEQ ID NO: 12904 - RNA, 1590 nt, Artificial Sequence
  derived and/or modified sequence opt1 from VP1__Norovirus_and/or_Norovirus-like__KM461690
augaagauggccagcuccgacgccgcgcccagcaacgacggcgccgccaaccuggugccggaggccaacaacgaggucauggcccucgagcccguggugggggcguccaucgccgcccccgucgugggccagcagaacaucaucgaccccuggauccgcgagaacuucgugcaggccccgcagggggaguucaccgucagcccccggaacucccccggcgagaugcugcugaaccucgagcuggggcccgagcugaacccguaccucagccaccugucccgcauguacaacggcuacgcgggcgggaugcagguccagguggugcuggccggcaacgccuucaccgccgggaagaucaucuucgccgcggugccgccccacuuccccguggagaacaucagcgccgcccagaucacgaugugcccccacgucaucguggacgugcggcagcucgagcccguccugcugccccuccccgacauccgcaaccgguucuuccacuacaaccaggagaacaccccgcgcaugcggcugguggccaugcuguacacgccccuccgcgccaacuccggcgaggacguguucaccgucagcugccgggugcugacccgccccgcgcccgacuucgaguucaccuuccuggugccgcccaccgucgaguccaagaccaagcccuucacgcuccccauccugacccugggggagcucagcaacucccgguucccggcccccaucgacaugcuguacaccgaccccaacgagggcaucguggugcagccccagaacggccgcugcacccuggacgggacgcuccagggcaccacccagcuggucccgacccagaucugcgccuuccgggggacgcugaucggccagaccagccgcuccagcgacuccaccgacagcgcgccccggcgccgggaccacccccuccacgugcagcugaagaaccuggacggcacccaguacgacccgacggacgagguccccgccgugcucggggccaucgacuucaagggcaccguguucggggucgccucccagcgcgacgugagcggccagcaggucggggccacccgggcccacgaggugcacaucaacaccacggacccccgcuacacccccaagcugggcagcauccugaugcacuccgagagcgacgacuucgugaccggccagccggugcgguucacccccaucgggaugggcgacaacgacuggcaccagugggagcuccccgacuacuccgggcgccugacgcugaacaugaaccucgcccccgcggucgccccggccuuccccggcgagcgcauccuguucuuccggagcaucgugcccuccgccgggggcuacggcagcgggcagaucgacugccugaucccccaggagugggugcagcacuucuaccaggaggcggccccgucccagagcgccgucgcccucauccgcuacgugaaccccgacaccggccggaacaucuucgaggccaagcugcaccgcgagggguucaucaccguggcgaacuccggcaacaaccccaucgucgugcccccgaacggguacuuccgguucgaggccugggugaacuga

SEQ ID NO: 12905 - RNA, 1587 nt, Artificial Sequence
  derived and/or modified sequence opt1 from VP1__Norovirus_and/or_Norovirus-like__JN400618
augaagauggccagcuccgacgccaaccccagcgacggcuccaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugagccaccuggcccgcauguacaacggcuacgccgggggcuucgaggugcaggucauccucgccgggaacgccuucacggcgggcaagaucaucuucgccgccgugccgcccaacuucccgaccgaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggccaacaacgcgggcgacgacguguucaccguguccugccgcguccugacccggcccagcccgcgcuucgagucccggaccaagcccuucagcgugcccgugcucacggucgaggagaugaccaacucccgcuuccccaucccgcuggagaagcuguucaccggccccagcuccgccuucguggugcagccccagaacgggcggugcaccacggacggcguccuccuggggaccacccagcugagccccgugaacaucugcaccuuccgcggcgacgucacgcacaucccgggcucccggaacuacaccaugaaccucgccagccagaacuggaacagcuacgggcccaccgaggagauccccgccccgcugggcacccccgacuucguggggaagauccagggcgugcugacgcagaccacccgcaccaacggguccacgcggggccacaaggccaccgucuacaccggcagcgcggacuucucccccaagcucgggcgcgugcaguucgccaccgacacggacaacgacuucgagaccaaccagaacaccaaguucacccccgugggcgucauccaggacgggagcacgaccccgcggaacgagccccagcagugggugcugcccuccuacagcggccgcaacauccacaacgugcaccuggcccccgccgucgccccgaccuuccccggggagcagcuccuguucuuccgguccaccaugcccggcugcagcggcuaccccaacauggaccuggacugccuccugccgcaggagugggugcaguacuucuaccaggaggcggcccccgcccaguccgacguggcccugcuccgcuucgucaaccccgacacggggcgggugcuguucgagugcaagcugcacaagagcggcuacgugaccgucgcgcacaccgggcagcacgaccucgugaucccgcccaacggcuacuuccgcuucgacuccugggugaaccaguucuacacccuggcccccauggggaacggcaccggccgccggcgcuga

SEQ ID NO: 12906 - RNA, 1587 nt, Artificial Sequence
  derived and/or modified sequence opt1 from VP1__Norovirus_and/or_Norovirus-like__JQ653095
augaagauggccagcaacgacgccgcgcccuccaacgacggcgccgccgggcuggugccggaggucaacaacgagaccauggcccucgagcccguggccggcgcgagcaucgccgcgccccugaccgggcagaacaacgugaucgaccccuggauccgccugaacuucguccaggcccacaacggcgaguucacgguguccccgcggaacagccccggggaggugcuccugaaccuggagcucggccccgagcugaaccccuaccuggcccaccucucccgcauguacaacggcuacgccgggggcgucgagguccaggugcugcuggccgggaacgccuucaccgccggcaagcucguguucgcggccgugccgccccacuucccccuggagaacaucagccccgggcagaucaccauguucccgcacgugaucaucgacguccggacccuggagcccgugcuccugccccugcccgacgugcgcaacaacuucuuccacuacaaccagcagaacgagccgcggaugcgccucgucgccaugcuguacacgccccugcgguccaacggcagcggcgacgacguguucaccguguccugccgcguccccacccggcccagcccggacuucgacuucaacuaccucgugccgcccaccguggaguccaagacgaagcccuucacccugcccauccugaccaucggggagcucaccaacagccgcuuccccguccccaucgacgagcuguacacgucccccaacgagagccugguggugcagccgcagaacggccggugcgcccucgacggggagcugcagggcaccacccagcugcuccccaccgccaucugcuccuuccgcggccggaucaaccagaaggucagcggggagaaccacguguggaacaugcaggucacgaacaucaacggcacccccuucgacccgaccgaggacgugcccgcgccccuggggacccccgacuucuccggcaagcuguucggggugcucagccagcgcgaccacgacaacgccugccggucccacgacgccgucaucgccacgaacagcgccaaguucaccccgaagcugggcgcgauccagaucggcaccugggagcaggacgacgugcacaucaaccagcccaccaaguucacgcccguggggcuguucgagagcgagggcuucaaccaguggacccuccccaacuacuccggggcccugaccccgaacaugggccuggccccgcccgucgcccccaccuuccccggggagcagauccucuucuuccgcagccacaucccccugaagggcggcguggccgaccccgugaucgacugccuggucccccaggaguggauccagcaccucuaccaggaguccgcgccgagccagacggacguggcccugauccgguucaccaaccccgacaccgggcgcgugcuguucgaggccaagcuccaccgguccggcuacaucaccgucgccaacacggggagccgccccaucguggugcccgcgaacggcuacuuccgguucgacuccugggucaaccaguucuacagccuggccccgguggggaccggcuga

SEQ ID NO: 12907 - RNA, 1587 nt, Artificial Sequence
  derived and/or modified sequence opt1 from VP1__Norovirus_and/or_Norovirus-like__JN183161
augaugauggccagcaaggacgcccccuccaacauggacggcaccagcggggcgggccagcuggugccggaggucaacgccgccgagccccucccccuggagcccguggugggggccgccaccgcggccgccacggccggccaggucaaccugaucgacccguggaucaugaacaacuucgugcaggcgcccgagggggaguucaccaucucccccaacaacacccccggcgacauccucuucgaccugcaccugggcccgcaccucaaccccuuccugcagcaccugagccagauguacaacgggugggugggcaacaugcgcguccgggugaugcucgccgggaacgccuucaccgccggcaagaucaucaucugcugcgugccgcccggguucgccucccagaacaucagcaucggccaggcgacgauguucccccacgucaucgccgacgugcgcgugcuggagcccaucgagaucccccuggacgacguccggaacguccucuuccacaccaacgagaaccgccccaccaugcggcugcugugcaugcucuacaccccgcugcgcgccggcggggccuccagcggcacggaccccuucgugaucgccgggcgggugcugaccugccccgcgcccgacuucaacuuccucuuccuggugccgcccuccguggagcagaagacccgccagcugaccguccccaacaucccccucaacaacauggccaacagccgggugccggccaugaucaacaagaugacgguguccagcgaccagaaccaggucgugcaguuccagaacggccgcugcacccuggagggccagcugcucgggaccacccccguguccgccagccaggucgcccggauccgcggcaagguguucuccacggcgagcgggaagggccugaaccugaccgagcucgacgggacccccuaccacgccuucgagucccccgccccgcugggcuuccccgacaucggcgccugcgacuggcacgucagcaccuucaagguggaccagaaccuguccggggaccccaugagccggcucgacaucaagcagaacgccccguucgcgccccaccugggcagcaucgaguucacguccgaccaggaccccaccggggaccagcugggcacccucgccugggugagccccuccaccagcgggacgcgcgucgacccguggaagauccccuccuacggcagcaccgugaccgaguccacccaccuggccccgcccaucuucccgcccggcuucggggaggccaucguguacuucaugagcgacuuccccaucgucuccggcaacacggcccaggugcccugcacccugccccaggaguucgugagccacuucgucgagcagcaggcgcccauccgcggggaggccgcccuccugcacuacguggaccccgacacccaccggaaccugggcgaguucaagcucuaccccgacggguucaucacgugcgugccgaacaccggcggcgggccccagaaccugcccaccaacggcgucuucguguucuccagcugggugucccgguacuaccagcugaagcccgucgggaccgccuga

SEQ ID NO: 12908 - RNA, 1587 nt, Artificial Sequence
  derived and/or modified sequence opt1 from VP1__Norovirus_and/or_Norovirus-like__KT906670
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacacggggcgcacccucuucgaggcgaagcugcaccgcuccggcuacaucaccguggcccacagcggggacuacccccuggugguccccgccaacggccacuuccgguucgacuccugggugaaccaguucuacagccucgccuga

SEQ ID NO: 12909 - RNA, 1587 nt, Artificial Sequence
  derived and/or modified sequence opt1 from VP1__Norovirus_and/or_Norovirus-like__KT906671
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccgaccggcaucugcgcguuccgcggccgggucaccgcccagaucaaccagcgcgaccgguggcacaugcagcugcagaaccucaacgggacgaccuacgaccccaccgacgacgugcccgccccgcugggcacccccgacuucaaggggguggucuucggcauggugucccagcgcaacgucgggaacgacgcccccggcagcacgcgggcccagcaggcguggguguccaccuacagcccccaguucgugccgaagcugggcagcgucaaccuccgcaucuccgacaacgacgacuuccaguuccagcccaccaaguucacccccgugggggugaacgacgacgacgacggccaccccuuccggcagugggagcugccgaacuacagcggggagcugacgcucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacaccgggcgcacccucuucgaggcgaagcugcaccgcagcggcuacaucaccguggcccacuccggggacuacccccuggugguccccgccaacggccacuuccgguucgacagcugggugaaccaguucuacucccucgccuga

SEQ ID NO: 12910 - RNA, 1587 nt, Artificial Sequence
  derived and/or modified sequence opt1 from VP1__Norovirus_and/or_Norovirus-like__AB810013
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaaccgcggggacaacugggaccagaaccugcugcagcucaccuaccccagcggcgccuccuacgacccgaccgacgaggugcccgcgccccugggcacgcaggacuucagcgggauccuguacggcgugcucacccaggacaacgucagcgaggggaccggcgaggccaagaacgccaaggggguguacaucuccaccacgagcggcaaguucacccccaagaucggcuccaucgggcugcacagcaucaccgagaacguccacccgaaccagcagucccgguucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccgcagccgggugcccugcguccaggggcugcgcggccaggacgcguucaucgacugccuccugccgcaggagugggugaaccacuucuaccaggaggccgcccccucccaggccgacguggcccugauccgguacgucaaccccgacaccggccgcacccucuucgaggcgaagcugcaccggagcggguucaucacggugucccacaccggcgccuacccccugguggucccgcccaacgggcacuuccgcuucgacagcugggugaaccaguucuacuccuga

SEQ ID NO: 12911 - RNA, 1584 nt, Artificial Sequence
  derived and/or modified sequence opt1 from VP1__Norovirus_and/or_Norovirus-like__EU096510
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgaccccaccaucaagcugaucgccaugcucuacacgccccugcgggccaacaacgcgggcgacgacguguucaccguguccugccgcguccugacccggccgagccccgacuucgacuucaucuuccucgugccgcccaccguggagucccgcacgaagcccuucaccguccccauccugaccguggaggagaugaccaacagccgguuccccaucccccuggagaagcuguucacgggcccguccggggccuucgugguccagccccagaacggccgcugcaccaccgacggggugcuccugggcaccacgcagcucagccccgucaacaucugcaccuuccggggcgacgugacccacaucgccgggacccacaacuacacgaugaaccuggccucccagaacuggaacaacuacgacccgaccgaggagauccccgcgccccugggcacccccgacuucguggggcgcauccagggcaugcucacccagacgacccgcggggacggcagcacccggggccacaaggccaccgucuccacgggggacgugcacuucaccccgaagcugggcagcauccaguucaacaccgacaccaacaacgacuucgagacggggcagaacaccaaguucacccccgugggcgucgugcaggacgggaacggcacccaccagaacgagccccagcagugggugcugcccuccuacagcggccggacggggcacaacgcccaccucgccccggccgucgcccccaccuuccccggcgagcagcugcuguucuuccgcagcaccaugcccgggugcuccggcuacccgaacaugaaccucgacugccugcugccccaggagugggugcagcacuucuaccaggaggcggcccccgcccagagcgacguggcccuccugcgguucgucaaccccgacaccgggcgcgugcuguucgagugcaagcuccacaaguccggcuacgugaccgucgcgcacacgggccagcacgaccuggugaucccgcccaacggguacuuccgguucgacagcugggugaaccaguucuacacccuguga

SEQ ID NO: 12912 - RNA, 1584 nt, Artificial Sequence
  derived and/or modified sequence opt1 from VP1__Norovirus_and/or_Norovirus-like__EU096513
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgaggcccaccagaacaccaaguucacccccgucggggugauccaggacggcuccacgacccaccgcaacgagccccagcagugggugcuccccagcuacuccgggcggaacguccacaacgugcaccuggccccggcgguggcccccaccuuccccggcgagcagcuccucuucuuccgcagcaccaugcccggcugcuccggguacccgaacauggaccuggacugccugcucccccaggaguggguccagcacuucuaccaggaggccgcccccgcgcagagcgacguggcccugcugcgguucgugaaccccgacacgggccgcguccucuucgagugcaagcugcacaaguccggguacgugaccguggcccacaccggccagcacgaccuggucaucccgcccaacggguacuuccgguucgacagcugggugaaccaguucuacacccucuga

SEQ ID NO: 12913 - RNA, 1584 nt, Artificial Sequence
  derived and/or modified sequence opt1 from VP1__Norovirus_and/or_Norovirus-like__EU096514
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcgggaccacccaccgcaacgagccccagcagugggugcuccccuccuacagcggccggaacguccacaacgugcaccuggccccggccguggcgcccaccuuccccggcgagcagcuccucuucuuccgcuccacgaugcccgggugcagcggcuacccgaacauggaccuggacugccugcucccccaggaguggguccagcacuucuaccaggaggccgcccccgcccaguccgacguggcgcugcugcgguucgugaaccccgacaccgggcgcguccucuucgagugcaagcugcacaagagcggcuacgugaccguggcccacaccgggcagcacgaccuggucaucccgcccaacggcuacuuccgguucgacuccugggugaaccaguucuacacccucuga

SEQ ID NO: 12914 - RNA, 1584 nt, Artificial Sequence
  derived and/or modified sequence opt1 from VP1__Norovirus_and/or_Norovirus-like__EU096512
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggcgaacaacgccggcgaggacguguucaccgugagcugccgcguccugacccggcccuccccggacuucgacuucaucuuccucgugccgcccaccguggagagccgcaccaagcccuucacgguccccauccugaccguggaggagaugaccaacucccgguuccccaucccccuggagaagcuguucaccggccccagcggggccuucgugguccagccgcagaacggccgcugcacgaccgacggggugcugcugggcaccacccagcucucccccgucaacaucugcacguuccggggcgacgugacccacaucgccgggagccgcaacuacaccaugaaccuggccucccugaacuggaacaacuacgaccccaccgaggagaucccggcgccccucggcacgcccgacuucguggggaagauccagggcguccugacccagaccaccaagggggacggcagcacgcggggccacaaggccaccguguacaccggguccgcccccuucaccccgaagcugggcagcgugcaguucagcacggacaccgagaacgacuucgagacccaccagaacaccaaguucacgcccgucggggugauccaggacggcuccaccacccaccgcaacgagccccagcagugggugcuccccagcuacuccgggcggaacguccacaacgugcaccuggccccggccguggcgcccaccuuccccggcgagcagcuccucuucuuccgcagcacgaugcccggcugcuccggguacccgaacauggaccuggacugccugcucccccaggaguggguccagcacuucuaccaggaggccgcccccgcccagagcgacguggcgcugcugcgguucgugaaccccgacaccggccgcguccucuucgagugcaagcugcacaaguccggguacgugaccguggcccacaccggccagcacgaccuggucaucccgcccaacggguacuuccgguucgacagcugggugaaccaguucuacacccucuga

SEQ ID NO: 12915 - RNA, 1581 nt, Artificial Sequence
  derived and/or modified sequence opt1 from VP1__Norovirus_and/or_Norovirus-like__KU311161
augaugauggccagcaaggacgcccccuccaacauggacggcaccagcggggcgggccagcuggugccggaggucaacgccgccgagccccucccccuggagcccguggugggggccgccaccgcggccgccacggccggccaggucaacaugaucgacccguggaucaugaacaacuucgugcaggcgcccgagggggaguucaccaucucccccaacaacacccccggcgacauccuguucgaccuccgccugggcccgcaccugaaccccuuccuccugcaccugagccagauguacaacgggugggugggcaacaugcggguccgcgugaugcucgccgggaacgccuucuccgccggcaagaucaucaucugcugcgugccgcccggguucgagagccagaacaucuccaucggccaggccaccauguucccccacgucaucgcggacgugcgggugcuggagcccaucgaggucccccuggacgacgugcgcaacguccucuuccacacgaacgagaaccggcccaccaugcgccugcugugcaugcucuacaccccgcugcgggccggcggggccagcuccggcaccgaccccuucgugaucgccgggcgcgugcugacgugccccgcccccgacuucaacuuccucuuccuggugccgcccagcgucgagcagaagacccggcagcugaccauccccaacaucccccucaacaaccuggcgaacucccgcgugccggccaugaucaacaagaugaccgugagcgccgaccagaaccaggucgugcaguuccagaacggccggugcacgcuggagggccagcuccuggggaccacccccguguccgccaaccaggucgcccgcauccggggcaagguguucagcaccaacuccgggacgggccugaaccucaccgaggucgacgggacccccuaccacgcguucgagagccccgccccgcugggcuuccccgacaucggcaacugcgacuggcacguguacgccuucaaggugaaccagaacaccggggaccccauguaccgccuggacaucacgcagggcaacuccuucgccccgcaccucgggagcaucgaguucuccagcgagaaccaccccagcggcgaccagcuggggacccugaccuggaucagcccccucaacaacgccucccgggucgaccccuggaagaucccgaccuacggcuccacgcugaccgagagcaccaaccuggcgccgcccaucuucccgcccggcuucggggaguccaucguguacuucaugagcgacuuccccaucguguccggcaacaccgcccagauccccugcacgcucccccaggaguucgucagcuccuucguggagcagcaggcccccauccgcggggaggccgcgcugcugcacuacguggaccccgacacccaccggaaccucggcgaguucaagcuguaccccgacggguucaucacgugcguccccaacaccggcggcgggccgcagaaccugcccagcaacggcguguucguguucuccagcugggucucccgcuacuaccagcucaagcccguggggaccuga

SEQ ID NO: 12916 - RNA, 1581 nt, Artificial Sequence
  derived and/or modified sequence opt1 from VP1__Norovirus_and/or_Norovirus-like__KX907730
augaugauggccagcaaggacgcccccuccaacauggacggcaccagcggggcgggccagcuggugccggaggucaacgccgccgagccccucccccuggagcccguggugggggccgccaccgcggucgccacggccggccaggugaacaugaucgacccguggaucaugaacaacuucgugcaggcccccgagggggaguucaccaucucccccaacaacacccccggcgacauccuguucgaccuccgccugggcccgcaccugaaccccuuccuccugcaccugagccagauguacaacgggugggucggcaacaugcgggugcgcgugaugcucgcggggaacgccuucuccgccggcaagaucaucaucugcugcgucccgcccggguucgagagccagaacaucuccaucggccaggccaccauguucccccacgugaucgccgacgugcggguccuggagcccaucgaggugccccuggacgacgugcgcaacguccucuuccacacgaacgagaaccggcccaccaugcgccugcugugcaugcucuacaccccgcugcgggcgggcggggccagcuccggcaccgaccccuucgugaucgccgggcgcgugcugacgugccccgcccccgacuucaacuuccucuuccuggucccgcccagcguggagcagaagacccggcagcugaccauccccaacaucccccucaacaaccuggccaacucccgcgugccggcgaugaucaacaagaugaccgucagcgccgaccagaaccagguggugcaguuccagaacggccggugcacgcuggagggccagcuccuggggaccacccccgucuccgccaaccagguggcccgcauccggggcaaggucuucagcaccaacuccgggacgggccugaaccucaccgagguggacgggacccccuaccacgccuucgagagccccgcgccgcugggcuuccccgacaucggcaacugcgacuggcacguguacgccuucaaggucaaccagaacaccggggaccccauguaccgccuggacaucacgcagggcaacuccuucgccccgcaccucgggagcaucgaguucuccagcgagaaccaccccagcggcgaccagcuggggacccugaccuggaucagcccccucaacaacgccucccggguggaccccuggaagaucccgaccuacggcuccacgcugaccgagagcaccaaccuggccccgcccaucuucccgcccggcuucggggaggcgaucguguacuucauguccgacuuccccaucgucagcggcaacaccgcccagauccccugcacgcucccccaggaguucguguccagcuucguggagcagcaggcccccauccgcggggaggccgcgcugcugcacuacgucgaccccgacacccaccggaaccucggcgaguucaagcuguaccccgacggguucaucacgugcgugcccaacaccggcggcgggccgcagaaccugcccuccaacggcguguucgucuucagcuccugggugagccgcuacuaccagcucaagcccguggggaccuga

SEQ ID NO: 12917 - RNA, 1581 nt, Artificial Sequence
  derived and/or modified sequence opt1 from VP1__Norovirus_and/or_Norovirus-like__EU096507
augaagauggccagcaacgacgccaaccccuccgacggcagcaccgcgaaccuggugccggaggucaacaacgaggugauggcccucgagcccguggucggggccgccaucgccgcgcccguggccggccagcagaacgugaucgaccccuggauccgcaacaacuucguccaggcccccgggggcgaguucaccgugagcccccggaacgcccccggggagauccugugguccgcgccccugggcccggaccucaaccccuaccugucccaccuggcccgcauguacaacggcuacgccgggggcuucgaggugcaggucauccucgccgggaacgccuucacggcgggcaagaucaucuucgccgccgugccgcccaacuucccgaccgaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacacgccccugcgggccaacaacgcgggcgacgacguguucaccgugagcugccgcguccugacccggcccuccccggacuucgacuucaucuuccucgugccgcccaccguggagagccgcacgaagcccuucaccguccccauccugaccguggaggagauguccaacagccgguuccccgugccccuggagaagcucuacaccggccccuccagcgccuucgucgugcagccgcagaacgggcgcugcacgaccgacggcguccugcuggggaccacccagcucuccgccgugaacaucugcacguuccggggcgacgugacccacaucgccggcagccacgacuacaccaugaaccuggccucccagaacuggaacaacuacgaccccaccgaggagauccccgcgccgcuggggacgcccgacuucgucggcaagauccagggggugcucacccagaccacccgcgaggacggcagcacgcgggcccacaaggccaccgugagcaccggguccguccacuucacccccaagcugggcagcgugcaguacacgaccgacaccaacaacgacuuccagaccggccagaacacgaaguucacccccgugggggucauccaggacggcuccaaccaccagaacgagccgcagcagugggugcugcccaacuacagcgggcgcaccggccacaacgugcaccucgcccccgccgucgcgcccaccuucccgggggagcagcugcuguucuuccgguccacgaugcccggcugcagcggcuaccccaacaugaaccucgacugccugcugccccaggagugggugcagcacuucuaccaggaggccgccccggcccaguccgacguggcgcuccugcgcuucgucaaccccgacaccgggcgggugcuguucgagugcaagcuccacaagagcggcuacgugaccgucgcccacaccgggccccacgaccuggugaucccgcccaacggcuacuuccgcuucgacuccugggugaaccaguucuacacccuguga

SEQ ID NO: 12918 - RNA, 1581 nt, Artificial Sequence
  derived and/or modified sequence opt1 from VP1__Norovirus_and/or_Norovirus-like__AB810007
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaaccgcggggacaacugggaccagaaccugcugcagcucaccuaccccagcggcgccuccuacgacccgaccgacgaggugcccgcgccccugggcacgcaggacuucagcgggauccuguacggcgugcucacccaggacaacgucagcgaggggaccggcgaggccaagaacgccaaggggguguacaucuccaccacgagcggcaaguucacccccaagaucggcuccaucgggcugcacagcaucaccgagaacguccacccgaaccagcagucccgguucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccgcagccgggugcccugcguccaggggcugcgcggccaggacgcguucaucgacugccuccugccgcaggagugggugaaccacuucuaccaggaggccgcccccucccaggccgacguggcccugauccgguacgucaaccccgacaccggccgcacccucuucgaggcgaagcugcaccggagcggguucaucacggugucccacaccggcgccuacccccugguggucccgcccaacgggcacuuccgcuucgacagcugggugaaccaguucuga

SEQ ID NO: 12919 - RNA, 1581 nt, Artificial Sequence
  derived and/or modified sequence opt1 from VP1__Norovirus_and/or_Norovirus-like__AB809989
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcggggccaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggguucaucacggugagccacaccggcgccuacccccugguggucccgcccaacgggcacuuccgguucgacuccugggugaaccaguucuga

SEQ ID NO: 12920 - RNA, 1581 nt, Artificial Sequence
  derived and/or modified sequence opt1 from VP1__Norovirus_and/or_Norovirus-like__AB810000
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaagcccuucacccugcccauccucaccaucuccgagcugacgaacagccgcuuccccaucccgaucgagcagcuguacaccgcgcccaacgagaacaacgucgugcagugccagaacggccggugcacccucgacggcgagcugcaggggaccacgcagcugcucuccagcgccgugugcuccuaccgcggccggaccgucgccaacagcggggacaacugggaccagaaccugcugcagcucaccuaccccuccggcgccagcuacgacccgaccgacgaggugcccgcgccccugggcacgcaggacuucagcgggauccuguacggcgugcucacccaggacaacgucuccgaggggaccggcgaggccaagaacgccaaggggguguacaucagcaccacguccggcaaguucacccccaagaucggcagcaucgggcugcacuccaucaccgagaacguccacccgaaccagcagagccgcuucacccccgugggcguggcccagaacgagaacacgcccuuccagcaguggguccugccccacuacgccggggcccucgcgcugaacaccaaccuggccccggccguggcccccaccuuccccggcgagcagcuccuguucuuccggucccgcgugcccugcguccaggggcugcggggccaggacgcguucaucgacugccuccugccgcaggagugggugaaccacuucuaccaggaggccgcccccagccaggccgacguggcccugauccgcuacgucaaccccgacaccggccggacccucuucgaggcgaagcugcaccgcuccggguucaucacggugagccacaccggcguguacccccuggucgugccgcccaacgggcacuuccgguucgacuccugggugaaccaguucuga

SEQ ID NO: 12921 - RNA, 1575 nt, Artificial Sequence
  derived and/or modified sequence opt1 from VP1__Norovirus_and/or_Norovirus-like__AB809999
augaagauggccagcaacgacgccgcgcccuccaacgacggcgccgccagccuggugccggaggccaucaacgagaccaugccccucgagcccgucgccggggcguccaucgccgcccccguggccggccagaccaacaucaucgacccguggauccgcacgaacuucgugcaggcgcccaacggggaguucaccgucagcccccggaacucccccggcgagauccugcugaaccucgagcuggggccggaccugaaccccuaccucgcccaccugagccgcauguacaacggcuacgccggcgggguggaggugcagguccugcucgccggcaacgccuucaccgcggggaagauccuguucgccgccaucccgcccaacuuccccguggacaugaucucccccgcccagaucaccaugcugccccaccucaucguggacguccggacgcuggagcccaucaugaucccgcugcccgacgugcgcaacguguucuaccacuucaacaaccagccccagccccggaugcgccucgucgccaugcuguacaccccgcugcggagcaacggcuccggggacgacguguucaccgugagcugccgcguccucacccggcccacgcccgacuucgaguucaucuaccuggugcccccguccguggagagcaagaccaaguccuucacccugcccauccucaccaucagcgagcugacgaacucccgcuuccccacccccaucgagcagcuguacaccgcgccgaacgagaacaacgucgugcagugccagaacggccggugcacccucgacggcgagcugcaggggacgacccagcugcucagcuccgccgugugcagcuaccgcggccggaccgucgccaacuccggggacaacugggaccagaaccugcugcagcucaccuaccccagcggcgccagcuacgaccccacggacgaggugccggcgccccugggcacccaggacuucuccgggauccuguacggcgggcucacccaggacaacgugagcgagggcaccggggaggccaagaacgccaagggcgucuacaucuccacgaccagcggcaaguucacccccaagaucggguccaucggccugcacagcaucaccgagaacgugcaccccaaccagcagucccgcuucacgccggucgggguggcccagaacgagaacacccccuuccagcagugggugcugccccacuacgccggcgcccucgcgcugaacaccaaccuggcccccgccgucgccccgaccuuccccggggagcagcuccuguucuuccggagccgcgugcccugcgugcagggccugcggggccaggacgcguucaucgacugccuccugccccaggagugggucaaccacuucuaccaggaggccgccccgucccaggccgacguggcccugauccgcuacgugaaccccgacacggggcggacccucuucgaggcgaagcugcaccgcagcggcuucaucaccgucucccacaccggggccuacccccugguggugcccccgaacggccacuuccgguucgacagcugggucaacuga

SEQ ID NO: 12922 - RNA, 1572 nt, Artificial Sequence
  derived and/or modified sequence opt1 from VP1__Norovirus_and/or_Norovirus-like__FJ692501
augaugauggccagcuccgacgccacgcccccgagcgagggcgcgaccaaccuggugcccgaggucaacacccagguggugccccucgagcccgucgccggggccgccgccgcggccccguucaccggccagaacaacgugaucgaccccuggaucuuccagaacuucgugcaggcgccccagggggaguucaccgucagcccccgcaacaccccgggcgagauccugcugcggaucccccucgggcccaaccugaaccccuuccuggcccaccucucccgcauguacaacgccugggugggcggcauggaggccgagaugauccuggccgggaacgccuucacggccggcaagcugcucaucguggcgcugccgcccggguucgaggccacccagcugacccccgcccaggccaccgccuucccccacgucaucgcggacgugcggacgcucgagccgauccccaucccccugcccgacauccgcaacgugcuguuccacuacaacggcgacccgacccccaccauccagaucgucgugaugcucuacacgccccugcggaccaacgggaacggcgacgacguguucaccgucuccggccgccugcucacccggcccgccccggacuucagcuucuccuuccuggugccgcccaccguggagcagaagacgcgccccuucacccugcccaaccucgccgucagcgaccuguccaacagccgguuccccgcccccgugaacauccugcgcgccgacccgaacaccacccucgcgcuggacuaccagaacgggcggugcacgcuggacggcgcccuccaggggaccacccccaccaacuccagcuuccugggcuaccugcgcggcacgguggaccgggucaacuccgaccaggugcacgugcaccuccgcgagcccaacggggaccccuuccagcugggccugccggggccccagggcguccccgacuaccgggccacccucgacaucuacguggacugggagaacaagaaccacgggaaccccugcgagggcacccugaacaccggcagccagacggaguacaccccggggcugggcacccucaccuucaacaagacguccggggacacccccgagcagggcgaccccgucaucaugcgccugguggccuuccggagcaaccugaccgaccagcuccccgccuacaacggggcguucggccagggcgagaaccuggccccgcccguguccccgcccguccccggggagguguuccugcaguucggcagccgcuacacccggcucggggagcgcgagcuggccgugcagugccugcuccccuccgaguggaucacgcacuucuacagcgaggccgcgcccauccagggcgaggccaugcugcugcgguacguccagcccgaccucgggcgcauccuguucgaggccaagcuguacaaggagggcuucgugaccguggccggcgggaccaacccggucaccuuccccaucgacggcaccuucguggccgugagcugggucucccgcaacuucgugcugagccccaugggguccggccagggccggcgccgguga

SEQ ID NO: 12923 - RNA, 1572 nt, Artificial Sequence
  derived and/or modified sequence opt1 from VP1__Norovirus_and/or_Norovirus-like__FJ692500
augaugauggccagcuccgacgccacgcccccgagcgagggcgcgaccaaccuggugcccgaggucaacacccagguggugccccucgagcccgucgccggggccgccgccgcggccccguucaccggccagaacaacgugaucgaccccuggaucuuccagaacuucgugcaggcgccccagggggaguucaccgucagcccccgcaacaccccgggcgagauccugcugcggaucccccucgggcccaaccugaaccccuuccuggcccaccucucccgcauguacaacgccugggugggcggcauggaggccgagaugauccuggccgggaacgccuucacggccggcaagcugcucaucguggcgcugccgcccggguucgaggccacccagcugacccccgcccaggccaccgccuucccccacgucaucgcggacgugcggacgcucgagccgauccccaucccccugcccgacauccgcaacgugcuguuccacuacaacggcgacccgacccccaccauccagaucgucgugaugcucuacacgccccugcggaccaacgggaacggcgacgacguguucaccgucuccggccgccugcucacccggcccgccccggacuucagcuucuccuuccuggugccgcccaccguggagcagaagacgcgcagcuucacccugcccaaccucgccgucuccgaccugagcaacucccgguuccccgcccccgugaacauccugcgcgccgaccccaacaccacccucgcgcuggacuaccagaacgggcggugcacgcuggacggcgcccuccaggggaccaccccgaccaacagcuccuuccugggcuaccugcgcggcacgguggaccgggucaacagcgaccaggugcacgugcaccuccgcgagcccaacggggaccccuuccagcugggccugcccgggccgcagggcguccccgacuaccgggccacccucgacaucuacguggacugggagaacaagaaccacgggaaccccugcgagggcacccugaacaccggcucccagacggaguacacccccgggcugggcacccucaccuucaacaagacgagcggggacaccccggagcagggcgaccccgucaucaugcgccugguggccuuccgguccaaccugaccgaccagcuccccgccuacaacggggcguucggccagggcgagaaccuggcgcccccggugagcccgcccguccccggggagguguuccugcaguucggcucccgcuacacccggcucggggagcgcgagcuggccgugcagugccugcuccccagcgaguggaucacgcacuucuacagcgaggccgcccccauccagggcgaggccaugcugcugcgguacguccagcccgaccucgggcgcauccuguucgaggccaagcuguacaaggagggcuucgugaccguggccggcgggaccaaccccgucaccuucccgaucgacggcaccuucguggccguguccugggucagccgcaacuucgugcugucccccauggggagcggccagggccggcgccgguga

SEQ ID NO: 12924 - RNA, 1572 nt, Artificial Sequence
  derived and/or modified sequence opt1 from VP1__Norovirus_and/or_Norovirus-like__AB031013
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcggcguccuguucgaccugagccucgggccccaccugaacccguuccugcuccaccugucccagauguacaacggcuggguggggaacaugcgcgugcggaucaugcuggcgggcaacgccuucaccgccgggaagaucaucgucagcugcaucccgcccggcuucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccgggggcgggaccggcgacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcgggaugggcaucuccccggacaacguccagagcgugcaguuccagaacgggcgcugcacccucgacggccggcugguggggacgacccccgucagccugucccacguggccaagauccgcggcaccagcaacggcaccgucaucaaccucacggagcuggacgggacccccuuccaccccuucgagggcccggcccccaucggguuccccgaccugggcgggugcgacuggcacaucaacaugacccaguucggccacuccagccagacccaguacgacguggacacgaccccggacaccuucgugccccaccucggcuccauccaggccaacgggaucggcagcgggaacuacaucggcguccuguccugggugagcccgcccucccaccccagcgggucccagguggaccuguggaagauccccaacuacggcagcuccaucaccgaggccacgcaccucgcccccagcgucuacccgcccggcuucggggaggugcugguguucuucauguccaagauccccggccccggggccuacagccugcccugccuccugccgcaggaguacaucucccaccuggccagcgagcaggcgcccaccgucggcgaggccgcccuccugcacuacguggaccccgacaccggccggacccugggggaguucaaggccuaccccgacggcuuccucacgugcgugccgaacggggccuccagcggcccccagcagcugcccaucaacggggucuucguguucgugagcugggucucccgcuucuaccagcugaagcccgugggcaccgcgagcuccgcccgguga

SEQ ID NO: 12925 - RNA, 1572 nt, Artificial Sequence
  derived and/or modified sequence opt1 from VP1__Norovirus_and/or_Norovirus-like__KU253442
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuccgugguggccggccgggucaugaccugccccagcccggacuucaacuuccuguuccucgugccgcccacgguggagcagaagacccgccccuucacccugcccaaccugccccucuccagccuguccaacagccgggcgccccugcccaucuccagcaugggcaucagcccggacaacguccaguccgugcagcuccagaacgggcgcugcacccuggacggccggcugguggggacgacccccgucagccucucccacguggccaagauccgcggcaccagcaacgggaccgccaucaaccugacggagcuggacggcacccccuuccaccccuucgagggcccggcccccaucgggcuccccgaccugggcgggugcgaccggcacaucaacaugacccaguucggccacuccagccagacccagcacgacgccgacacgaccccggacaccuccgucccccaccuggggagcauccaggccaacggcaucggcuccgggaacuacgugggcgugcucagcuggaucuccccgcccagccaccccuccgggagccaggucgaccuguggaagauccccaacuacggcuccagcaucaccgaggccacgcaccuggcccccuccguguacccgcccggguucggcgaggugcucgucuucuucaugagcaagaugcccggccccggggcguacaaccugcccugccugcucccgcaggaguacaucucccaccuggccagcgagcaggcccccaccgugggcgaggccgcccugcuccacuacguggaccccgacaccgggcgcaaccugggcgaguucaaggcguaccccgacggcuuccugaccugcgucccgaacggggccagcuccggcccccagcagcuccccaucaacgggguguucguguucgucagcugggugucccgguucuaccagcugaagcccgugggcacggccagcuccgcccgcuga

SEQ ID NO: 12926 - RNA, 1572 nt, Artificial Sequence
  derived and/or modified sequence opt1 from VP1__Norovirus_and/or_Norovirus-like__EF547392
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcggcauggggaucuccccggacaacguccagagcgugcaguuccagaacggccgcugcacccucgacgggcggcuggugggcacgacccccgucagccugucccacguggccaagauccgcgggaccagcaacggcaccgucaucaaccucacggagcuggacggcacccccuuccaccccuucgaggggccggcccccaucggcuuccccgaccucgggggcugcgacuggcacaucaacaugacccaguucgggcacuccagccagacccaguacgacguggacacgaccccggacaccuucgugccccaccucggcuccauccaggccaacggcgucagcuccgggaacuacaucggcgugcugagcuggguguccccgcccagccaccccuccgggagccaggucgaccuguggaagauccccaacuacggcuccagcaucaccgaggccacgcaccucgcccccuccguguacccgcccggguucggcgaggugcuggucuucuucaugagcaagauccccggccccggggccuacucccugcccugccuccugccgcaggaguacaucagccaccuggccuccgagcaggcgcccaccgugggcgaggccgcccuccugcacuacguggaccccgacaccgggcggaaccugggcgaguucaaggccuaccccgacggcuuccugaccugcgucccgaacggggccagcagcggcccccagcagcugcccaucaacgggguguucguguucgucuccugggugagccgcuucuaccagcugaagcccgugggcacggcguccaccgcccgguga

SEQ ID NO: 12927 - RNA, 1572 nt, Artificial Sequence
  derived and/or modified sequence opt1 from VP1__Norovirus_and/or_Norovirus-like__KT943503
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucaccgaggccacgcaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccaccgucggcgaggccgcccuccugcacuacguggaccccgacaccgggcggaaccugggcgaguucaaggccuaccccgacggcuuccugaccugcgugccgaacggggccuccagcggcccccagcagcuccccaucaacggggucuucguguucgugagcugggucucccgcuucuaccagcugaagcccgugggcacggcgagcuccgcccgguga

SEQ ID NO: 12928 - RNA, 1572 nt, Artificial Sequence
  derived and/or modified sequence opt1 from VP1__Norovirus_and/or_Norovirus-like__AY502016
augaugauggccagcaaggacgccaccuccaacguggacggcgcgagcggggccggccagcugguccccgaggccaacaccuccgacccgcucgccauggaccccguggccgggagcuccacggcgguggccaccgccggccaggucaaccccaucgaccccuggaucaucaacaacuucgugcaggccccgcagggggaguucaccaucagccccaacaacacccccggcgacgugcuguucgaccugucccucggcccccaccugaacccguuccugcuccaccugagccagauguacaacgggugggucggcaacaugcgcgugcggaucaugcuggcggggaacgccuucacggccggcaagaucaucguguccugcaucccgcccggguucggcagccacaaccucaccaucgcccaguccacccuguucccccacgucaucgccgacgugcgcacccuggaccccaucgaggugccccucgaggacguccggaacgugcuguuccacaacaacgaccgcaaccagcagacgaugcggcuggugugcaugcucuacacgccccugcgcaccggcgggggcaccggggacagcuucgucguggcgggccgggugaugaccugccccuccccggacuucaacuuccuguuccucgucccgcccaccguggagcagaagacccgccccuucacccugcccaaccugccccucagcucccugagcaacucccgggcgccccugcccaucagcuccaugggcaucagcccggacaacgugcagagcguccaguuccagaacgggcgcugcacgcucgacggccggcugguggggaccacccccgugucccugagccaggucgccaagauccgcggcaccuccaacgggacggugaucaaccucaccgagcuggacggcacccccuuccaccccuucgagggcccggcccccaucggguuccccgaccugggcgggugcgacuggcacgucaacaugacccaguucggccacagcucccagacgcaguucgacguggacaccaccccggagaccuucgugccccaccucgggagcauccaggccaacggcgucggcuccgggaacuacaucggcgugcugagcuggaucuccccgcccagccaccccuccgggagccagguggaccuguggaagauccccaacuacggcuccagcaucacggaggccacccaccucgcccccuccgucuucccgcccggguucggcgaggugcugguguucuucaugagcaagauccccggccccggggccuacaaccugcccugccuccugccgcaggaguacaucucccacuucgccagcgagcaggcccccaccgucggcgaggcggcccugcuccacuacguggaccccgacaccgggcggaaccugggcgaguucaaggccuaccccgacggcuuccugacgugcgugccgaacggggccuccagcggcccccagcagcuccccaucaacggggucuucguguucgugagcugggucucccgcuucuaccagcugaagcccgugggcaccgccagcuccgcgcgguga

SEQ ID NO: 12929 - RNA, 1572 nt, Artificial Sequence
  derived and/or modified sequence opt1 from VP1__Norovirus_and/or_Norovirus-like__KU253446
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucaccgaggccacgcaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccaccgucggcgaggccgcccuccugcacuacguggaccccgacaccgggcggaaccugggcgaguucaaggccuaccccgacggcuuccugaccugcgugccgaacggggccuccagcggcccccagcagcuccccaucaucggggucuucguguucgugagcugggucucccgcuucuaccagcugaagcccgugggcacggcgagcuccgcccgguga

SEQ ID NO: 12930 - RNA, 1572 nt, Artificial Sequence
  derived and/or modified sequence opt1 from VP1__Norovirus_and/or_Norovirus-like__KU253445
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccuggcgccccuccccaucagcuccaugggcaucagcccggacaacguccagagcgugcaguuccagaacgggcggugcacccuggacggccgccugguggggacgacccccgucucccucagccacguggccaagauccggggcaccuccaacgggaccgucaucaaccugacggagcuggacggcacccccuuccaccccuucgagggcccggcccccaucggguuccccgaccucggcgggugcgacuggcacaucaacaugacccaguucggccacagcucccagacccaguacgacguggacacgaccccggacaccuucgugccccaccuggggagcauccaggccaacggcaucggcuccgggaacuacgucggcgugcugagcuggaucuccccgcccagccaccccuccgggagccagguggaccucuggaagauccccaacuacggcuccagcaucaccgaggccacgcaccuggcccccuccgucuacccgcccggguucggcgaggugcugguguucuucaugagcaagaugcccggccccggggccuacaaccuccccugccugcugccgcaggaguacaucucccaccucgccagcgagcaggcgcccaccgucggcgaggccgcccugcugcacuacguggaccccgacaccgggcgcaaccucggcgaguucaaggccuaccccgacggcuuccugaccugcgugccgaacggggccuccagcggcccccagcagcugcccaucaacggggucuucguguucgugagcugggucucccgguucuaccagcucaagcccgugggcacggcgagcuccgcccgcuga

SEQ ID NO: 12931 - RNA, 1572 nt, Artificial Sequence
  derived and/or modified sequence opt1 from VP1__Norovirus_and/or_Norovirus-like__KF039735
augaugauggccagcaaggacgccaccuccagcguggacggcgcguccggggccggccagcugguccccgaggugaacgccagcgacccgcucgccauggaccccguggccggguccagcaccgcggucgccacgaccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggccgggaacgcguucacggccggcaagaucaucgucagcugcaucccgcccggguucggcucccacaaccucaccaucgcccaggccacccuguucccccacgugaucgccgacgugcgcacccuggaccccaucgaggucccccucgaggacgugcggaacgugcuguuccacaacaacgaccgcaaccagcagacgaugcggcuggucugcaugcucuacacgccccugcgcaccggcgggggcaccggggacagcuucgugguggcgggccgggucaugaccugccccuccccggacuucaacuuccuguuccucgugccgcccaccguggagcagaagacccgccccuucacccugcccaaccugccccucagcucccugagcaacucccgggcgccccugcccaucagcuccaugggcaucagcccggacaacguccagagcgugcaguuccagaacgggcgcugcacgcucgacggccggcugguggggaccacccccgucucccugagccacguggccaagauccgcggcaccuccaacgggacggucaucaaccucaccgagcuggacggcacccccuuccaccccuucgagggcccggcccccaucggguuccccgaccugggcgggugcgacuggcacaucaacaugacccaguucggccacagcucccagacgcaguacgacguggacaccaccccggacaccuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucacggaggccacccaccucgcccccuccgucuacccgcccggguucggcgaggugcugguguucuucaugagcaagaugcccggccccggggccuacaaccugcccugccuccugccgcaggaguacaucucccaccuggccagcgagcaggcccccaccgucggcgaggcggcccuccugcacuacguggaccccgacaccgggcggaaccugggcgaguucaaggccuaccccgacggcuuccucacgugcgugccgaacggggccuccagcggcccccagcagcugcccaucaacggggucuucguguucgugagcugggucucccgcuucuaccagcugaagcccgugggcaccgccagcuccgcgcgguga

SEQ ID NO: 12932 - RNA, 1572 nt, Artificial Sequence
  derived and/or modified sequence opt1 from VP1__Norovirus_and/or_Norovirus-like__KF039732
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggugaccuucgucccccaccucgggagcauccaggccaacggcaucggcuccgggaacuacgugggcgugcugagcuggaucuccccgcccagccaccccuccgggagccaggucgaccuguggaagauccccaacuacggcuccagcaucaccgaggccacgcaccucgcccccuccguguacccgcccggguucggcgaggugcuggucuucuucaugagcaagaugcccggccccggggccuacaaccugcccugccuccugccgcaggaguacaucucccaccuggccagcgagcaggcgcccaccgugggcgaggccgcccuccugcacuacguggaccccgacaccgggcggaaccugggcgaguucaaggccuaccccgacggcuuccugaccugcgucccgaacggggccuccagcggcccccagcagcuccccaucaacgggguguucguguucgucagcugggugucccgcuucuaccagcugaagcccgugggcacggcgagcuccgcccgguga

SEQ ID NO: 12933 - RNA, 1572 nt, Artificial Sequence
  derived and/or modified sequence opt1 from VP1__Norovirus_and/or_Norovirus-like__KF039734
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcaucggcuccgggaacuacgucggcgugcugagcuggaucuccccgcccagccggcccuccgggagccagguggaccuguggaagauccccaacuacggcuccagcaucaccgaggccacgcaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccaccgucggcgaggccgcccuccugcacuacguggaccccgacaccgggcgcaaccugggcgaguucaaggccuaccccgacggcuuccugaccugcgugccgaacggggccuccagcggcccccagcagcuccccaucaacggggucuucguguucgugagcugggucucccgguucuaccagcugaagcccgugggcacggcgagcuccgcccgcuga

SEQ ID NO: 12934 - RNA, 1572 nt, Artificial Sequence
  derived and/or modified sequence opt1 from VP1__Norovirus_and/or_Norovirus-like__KF039729
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcgucggcuccgggaacuacgugggcgugcugagcuggaucuccccgcccagccaccccuccgggagccaggucgaccuguggaagauccccaacuacggcuccagcaucaccgaggccacgcaccucgcccccuccguguacccgcccggguucggcgaggugcuggucuucuucaugagcaagaugcccggccccggggccuacaaccugcccugccuccugccgcaggaguacaucucccaccuggccagcgagcaggcgcccaccgugggcgaggccgcccuccugcacuacguggaccccgacaccgggcggaaccugggcgaguucaaggccuaccccgacggcuuccugaccugcgucccgaacggggccuccagcggcccccagcagcuccccaucaacgggguguucguguucgucagcugggugucccgcuucuaccagcugaagcccgugggcacggcgagcuccgcccgguga

SEQ ID NO: 12935 - RNA, 1572 nt, Artificial Sequence
  derived and/or modified sequence opt1 from VP1__Norovirus_and/or_Norovirus-like__KF039737
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacgugaacacgaccccggacaccuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucaccgaggccacgcaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccaccgucggcgaggccgcccuccugcacuacguggaccccgacaccgggcggaaccugggcgaguucaaggccuaccccgacggcuuccugaccugcgugccgaacggggccuccagcggcccccagcagcuccccaucaacggggucuucguguucgugagcugggucucccgcuucuaccagcugaagcccgugggcacggcgagcuccgcccgguga

SEQ ID NO: 12936 - RNA, 1572 nt, Artificial Sequence
  derived and/or modified sequence opt1 from VP1__Norovirus_and/or_Norovirus-like__KF039731
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcuccaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaucuucgugccccaccucgggagcauccaggccaacggcaucggcuccgggaacuacgucggcgugcugagcuggaucuccccgcccagccaccccuccgggagccagguggaccuguggaagauccccaacuacggcuccagcaucaccgaggccacccaccucgcccccuccgucuacccgcccggguucggcgaggugcugguguucuucaugagcaagaugcccggccccggggccuacaaccugcccugccuccugccgcaggaguacaucucccaccuggccagcgagcaggcgcccacggucggcgaggccgcccuccugcacuacguggaccccgacaccgggcggaaccugggcgaguucaaggccuaccccgacggcuuccugaccugcgugccgaacggggccuccagcggcccccagcagcuccccaucaacggggucuucguguucgugagcugggucucccgcuucuaccagcugaagcccgugggcaccgcgagcuccgcccgguga

SEQ ID NO: 12937 - RNA, 1563 nt, Artificial Sequence
  derived and/or modified sequence opt1 from VP1__Norovirus_and/or_Norovirus-like__KT732279
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagccuggugguggccggccgggucaugaccugccccuccccggacuucaacuuccucuuccuggugccgcccacgguggagcagaagacccgccccuucacccugcccaaccucccccugagcucccugagcaacucccgggcgccccuccccaucagcggcauggggaucuccccggacaacguccagagcgugcaguuccagaacggccgcugcacccuggacgggcggcuggugggcacgacccccgucagccucucccacguggccaagauccgcgggaccagcaacggcaccgucaucaaccugacggagcuggacggcacccccuuccaccccuucgaggggccggcccccaucggcuuccccgaccucgggggcugcgacuggcacaucaacaugacccaguucgggcacuccagccagacccaguacgacguggacacgaccccggacaccuucgugccccaccugggcuccauccaggccaacggcaucaacagcgggaacuacaucggcguccuguccugggugagcccgcccucccaccccagcgggucccagguggaccucuggaagauccccaacuacggcagcuccaucaccgaggccacgcaccuggcccccagcgucuucccgcccggguucggcgaggugcugguguucuucauguccaagauccccggccccggggccuacagccuccccugccugcugccgcaggaguacaucucccaccucgccagcgagcaggcgcccaccgucggcgaggccgcccugcugcacuacguggaccccgacaccgggcggaaccucggcgaguucaaggccuaccccgacggcuuccugaccugcgugccgaacggggccuccagcggcccccagcagcugcccaucaacggggucuucguguucgugagcugggucucccgcuucuaccagcucaagcccgugggcacggcgagcuga

SEQ ID NO: 12938 - RNA, 1563 nt, Artificial Sequence
  derived and/or modified sequence opt1 from VP1__Norovirus_and/or_Norovirus-like__FJ384783
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcgggggcaccggggacagcuucgugguggccggccgggucaugaccugccccuccccggacuucaacuuccuguuccucgugccgcccacgguggagcagaagacccgccccuucacccugcccaaccugccccucagcucccugagcaacucccgggcgccccugcccaucagcggcauggggaucuccccggacaacguccagagcgugcaguuccagaacggccgcugcacccucgacgggcggcuggugggcacgacccccgucagccugucccacguggccaagauccgcgggaccagcaacggcaccgucaucaaccucacggagcuggacggcacccccuuccaccccuucgaggggccggcccccaucggcuuccccgaccucgggggcugcgacuggcacaucaacaugacccaguucgggcacuccagccagacccaguacgacguggacacgaccccggacaccuucgugccccaccucggcuccauccaggccaacggcaucaacagcgggaacuacaucggcguccuguccugggugagcccgcccucccaccccagcgggucccagguggaccuguggaagauccccaacuacggcagcuccaucaccgaggccacgcaccucgcccccagcgucuucccgcccggguucggcgaggugcugguguucuucauguccaagauccccggccccggggccuacagccugcccugccuccugccgcaggaguacaucucccaccuggccagcgagcaggcgcccaccgucggcgaggccgcccuccugcacuacguggaccccgacaccgggcggaaccugggcgaguucaaggccuaccccgacggcuuccugaccugcgugccgaacggggccuccagcggcccccagcagcugcccaucaacggggucuucguguucgugagcugggucucccgcuucuaccagcugaagcccgugggcacggcgagcuga

SEQ ID NO: 12939 - RNA, 1563 nt, Artificial Sequence
  derived and/or modified sequence opt1 from VP1__Norovirus_and/or_Norovirus-like__EU085522
augaugauggccagcaaggacgccaccuccagcguggacggcgcguccggggccggccagcugguccccgaggugaacgccagcgacccgcucgccauggaccccguggccggguccagcaccgcggucgccacggccggccaggugaaccccaucgaccccuggaucaucaacaacuucgugcaggccccgcagggggaguucaccaucucccccaacaacacccccggcgacguccuguucgaccugagccucggcccccaccugaacccguuccugcuccaccugucccagauguacaacgggugggugggcaacaugcgcgugcggaucaugcuggcggggaacgccuucaccgccggcaagaucaucgucagcugcaucccgcccggguucggcucccacaaccucacgaucgcccaggccacccuguucccccacgugaucgcggacgugcgcacccuggaccccaucgaggucccccucgaggacgugcggaacgugcuguuccacaacaacgaccgcaaccagcagaccaugcggcuggucugcaugcucuacacgccccugcgcaccggcagcgggaccggcgacuccuucgugguggccgggcgggucaugaccugccccagcccggacuucaacuuccuguuccucgugccgcccacgguggagcagaagacccgccccuucacccugcccaaccugccccucuccagccuguccaacagccgggcgccccugcccaucuccggcaugggcaucagcccggacaacguccagagcgugcaguuccagaacgggcgcugcacccucgacggccggcugguggggacgacccccgucucccugagccacguggccaagauccgcggcaccuccaacgggaccgucaucaaccucacggagcuggacggcacccccuuccaccccuucgagggcccggcccccaucggguuccccgaccugggcgggugcgacuggcacaucaacaugacccaguucggccacagcucccagacccaguacgacguggacacgaccccggacaccuucgugccccaccucgggagcauccaggccaacggcaucaacuccggcaacuacaucgggguccugagcuggguguccccgcccagccaccccuccggcagccagguggaccuguggaagauccccaacuacggguccagcaucaccgaggccacgcaccucgcccccuccgucuucccgcccggcuucggggaggugcugguguucuucaugagcaagauccccggccccggcgccuacucccugcccugccuccugccgcaggaguacaucagccaccuggccuccgagcaggcgcccaccgucggggaggccgcccuccugcacuacguggaccccgacaccggccggaaccugggggaguucaaggccuaccccgacggcuuccugaccugcgugccgaacggcgccagcagcgggccccagcagcuccccaucaacggcgucuucguguucguguccugggucagccgcuucuaccagcugaagcccguggggacggcguccuga

SEQ ID NO: 12940 - RNA, 1563 nt, Artificial Sequence
  derived and/or modified sequence opt1 from VP1__Norovirus_and/or_Norovirus-like__L23828
augaugauggccagcaaggacgccaccuccagcguggacggcgcguccgccagcguccagcuggugcccgaggugaacgccuccgacccgcucgccauggaccccgucgccgggagcuccaccgcgguggccacggccggccaggugaaccccaucgaccccuggaucaucaacaacuucguccaggccccgcagggggaguucaccaucagccccaacaacacccccggcgacgugcuguucgaccugucccucgggccccaccugaacccguuccugcuccaccugagccagauguacaacggcugggugggcaacaugcgcguccggaucaugcuggcggggaacgccuucaccgccggcaagaucaucguguccugcaucccgcccggguucggcagccagcagcucacgaucgcccaggccacccuguucccccacgugaucgcggacguccgcacccuggaccccaucgaggugccccucgaggacgugcggaacguccuguuccacaacaacgaccgcaaccagcagaccaugcggcuggugugcaugcucuacacgccccuguccaccgggggcggcaccggggacagcuucguggucgccggccgcgugaugaccugccccuccccggacuucaacuuccuguuccucgugccgcccacggucgagcagaagacccggcccuucacccugcccaaccugccccucagcucccugagcaacucccgcgcgccccugcccaucagcgggaugggcaucagcccggacaacgugcaguccgugcaguuccagaacggccggugcacccucgacgggcgccuggucggcacgacccccgugagccugucccacgucgccaagauccgggggaccagcaacggcaccgugaucaaccucacggagcuggacgggacccccuuccaccccuucgagggcccggcccccaucggcuuccccgaccucgggggcugcgacuggcacaucaacaugacccaguucgggcacuccagccagacccaguacgacguggacacgaccccggacaccuccgucccccaccucggcagcauccaggccaacgggaucggcuccggcaacuacaucggggugcugagcuggguguccccgcccagccaccccuccggcagccaggucgaccuguggaagauccccaacuacggguccagcaucaccgaggccacgcaccucgcccccuccguguacagccccggcuucggggaggugcuggucuucuucauguccaagaucccgggccccggcggggacagccugcccugccuccugccccagggcuacaucagccaccuggccuccgagcaggccccgaccgugggggagggcccccuccugcacuacguggaccccgacaccgaccgcaaccugggcgaguucaaggcguaccccgacggguuccugaccugcgucccgaacggcgccagcuccgggccccagcagcugcccaucaacggcguguucguguucgucagcugggugucccgguucuaccagcugaagcccguggggacggccagcuga

SEQ ID NO: 12941 - RNA, 1563 nt, Artificial Sequence
  derived and/or modified sequence opt1 from VP1__Norovirus_and/or_Norovirus-like__KX764843
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgaggugcugcucaaccuggagcugggcccggaccucaaccccuaccuggcgcaccugagccgcauguacaacggguacgccggcgggguggagguccaggugcuccuggccggcaacgccuucaccgccgggaagauccuguucgcggccgugccgcccaacuuccccgucgaguuccucucccccgcccagaucaccaugcugccccaccugaucguggacgugcggacgcucgagcccaucaugaucccgcugcccgacguccgcaacaccuucuuccacuacagcaaccagcccaacucccggaugcgccugguggccaugcucuacacgccccugcggagcaacggcuccggcgacgacguguucaccgucagcugccgcgugcugacccggccgacccccgacuucgaguucaccuaccucgugccgcccuccgucgagagcaagaccaagcccuucucccugcccauccugacgcucagcgagcugaccaacucccgcuuccccgugcccaucgacagccuguucaccgcccagaacaacgugcuccagguccagugccagaacgggcggugcacccuggacggcgagcugcaggggacgacccagcuccugccguccggcaucugcgcguuccgcggccgggugaccgcccagaucaaccagcgcgaccgguggcacaugcagcugcagaaccucaacgggaccacguacgaccccaccgacgacgugcccgccccgcugggcacccccgacuucaagggggucguguucggcauggucagccagcgcaacguggggaacgacgcccccggcuccacccgggcccagcaggcgugggugagcacguacagcccccaguucgucccgaagcugggcuccgugaaccuccgcaucagcgacaacgacgacuuccaguuccagcccaccaaguucacccccgugggggucaacgacgacgacgacggccaccccuuccggcagugggagcugccgaacuacuccggggagcugacccucaacaugaaccuggccccgcccguggcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacgucgcccugauccgguacgugaacccggacacggggcgcacccucuucgaggcgaagcugcaccgcuccggcuacaucaccguggcccacagcggggacuacccccuggucgugcccgccaacggccacuuccgguucgacgccugguga

SEQ ID NO: 12942 - RNA, 1563 nt, Artificial Sequence
  derived and/or modified sequence opt1 from VP1__Norovirus_and/or_Norovirus-like__KX764841
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcgcaugcagcugcagaaccucaacgggaccacguacgaccccaccgacgacgugcccgccccgcugggcacccccgacuucaaggggguggucuucggcauggugagccagcggaacgucgggaacgacgcccccggcuccacccgcgcccagcaggcgugggugagcacguacagcccccaguucgugccgaagcugggcuccgucaaccuccggaucagcgacaacgacgacuuccaguuccagcccaccaaguucacccccgugggggugaacgacgacgacgacggccaccccuuccgccagugggagcugccgaacuacuccggggagcugacccucaacaugaaccuggccccgcccgucgcccccaacuuccccggcgagcagcuccuguucuuccggagcuucgugcccugcuccgggggcuacaaccagggcaucaucgacugccugaucccccaggaguggauccagcacuucuaccaggagagcgcccccucccagagcgacguggcccugauccgcuacgucaacccggacacggggcgcacccucuucgaggcgaagcugcaccgguccggcuacaucaccguggcccacagcgggggcuacccccuggugguccccgccaacgggcacuuccgcuucgaguccugguga

SEQ ID NO: 12943 - RNA, 1563 nt, Artificial Sequence
  derived and/or modified sequence opt1 from VP1__Norovirus_and/or_Norovirus-like__KX764840
augaagauggccagcuccgacgccgcgcccagcaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacuccaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugucccagcgcaacgucgggaacgacgcccccggcagcacccgggcccagcaggcgugggugagcacguacagcccccaguucgugccgaagcugggcuccgucaaccuccgcaucuccgacaacgacgacuuccaguuccagcccaccaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacacggggcgcacccucuucgaggcgaagcugcaccgcagcggcuacaucaccguggcccacuccggggacuacccccuggugguccccgccaacggccacuuccgguucgacagcugguga

SEQ ID NO: 12944 - RNA, 1563 nt, Artificial Sequence
  derived and/or modified sequence opt1 from VP1__Norovirus_and/or_Norovirus-like__KT864687
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacccggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcaggggacgacccagcuccugccguccggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccgucaaccuccgcaucagcgacaacgacgacuuccaguuccagcccaccaaguucacccccgugggggugaacgacgacgacgacggccaccccuuccggcagugggagcugccgaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacguggcccugauccgguacgucaacccggacacggggcgcacccucuucgaggcgaagcugcaccgcuccggcuacaucaccguggcccacagcggggacuacccccuggugguccccgccaacggccacuuccgguucgaguccugguga

SEQ ID NO: 12945 - RNA, 1563 nt, Artificial Sequence
  derived and/or modified sequence opt1 from VP1__Norovirus_and/or_Norovirus-like__KX764842
augaagauggccagcaacgacguggcccccuccaacgacggcgcggccgggcuggucccggagggcaacaacgagacccucccccuggagcccguggccggggccgccaucgcggcccccgugaccggccagaacaacaucaucgacccguggauccgcacgaacuucguccaggcccccaacggggaguucaccgugagcccccggaacucccccggcgagauccugcucaaccuggagcugggcccggaccucaaccccuaccuggcccaccugagccgcauguacaacggguacgcgggcgggguggagguccaggugcuccuggccggcaacgccuucaccgccgggaagauccuguucgccgcggugccgcccaacuuccccgucgaguuccucucccccgcccagaucaccaugcugccccaccugaucguggacgugcggacgcucgagcccaucaugaucccgcugcccgacguccgcaacaccuucuuccacuacagcaaccagcccaacucccggaugcgccugguggccaugcucuacacgccccugcggagcaacggcuccggcgacgacguguucaccgucagcugccgcgugcugacccggccgacccccgacuucgaguucaccuaccucgugccgcccuccgucgagagcaagaccaagcccuucucccugcccauccugacgcucagcgagcugaccaacucccgcuuccccgugcccaucgacagccuguucaccgcccagaacaacgugcuccagguccagugccagaacgggcggugcacccuggacggcgagcugcaggggacgacccagcuccugccguccggcaucugcgccuuccgcggccgggugaccgcgcagaucaaccagcgcgaccgguggcacaugcagcugcagaaccucaacgggaccacguacgaccccaccgacgacgugcccgccccgcugggcacccccgacuucaagggggucguguucggcauggucagccagcgcaacguggggaacgacgcccccggcuccacccgggcccagcaggccugggugagcacguacagcccccaguucgucccgaagcugggcuccgugaaccuccgcaucagcgacaacgacgacuuccaguuccagcccaccaaguucacccccgugggggucaacgacgacgacgacggccaccccuuccggcagugggagcugccgaacuacuccggggagcugacccucaacaugaaccuggcgccgcccguggcccccaacuuccccggcgagcagcuccuguucuuccgcagcuucgugcccugcuccgggggcuacaaccagggcaucaucgacugccugaucccccaggaguggauccagcacuucuaccaggagagcgcccccucccagagcgacgucgcccugauccgguacgugaacccggacacggggcgcacccucuucgaggccaagcugcaccgcuccggcuacaucaccguggcgcacagcggggacuacccccuggucgugcccgccaacggccacuuccgguucgacgccugguga

SEQ ID NO: 12946 - RNA, 1563 nt, Artificial Sequence
  derived and/or modified sequence opt1 from VP1__Norovirus_and/or_Norovirus-like__KT864685
augaagauggccagcuccgacgccgcgcccagcaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacuccaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugucccagcgcaacgucgggaacgacgcccccggcagcacccgggcccagcaggcgugggugagcacguacagcccccaguucgugccgaagcugggccccgucaaccuccgcaucuccgacaacgacgacuuccaguuccagcccaccaaguucacccccgugggggugaacgacgacgacgacggccacccguuccggcagugggagcugcccaacuacuccggggagcugacccucaacaugaaccuggccccgcccgucgcccccaacuuccccggcgagcagcuccuguucuuccgcagcuucgugcccugcuccgggggcuacaaccagggcaucaucgacugccugaucccccaggaguggauccagcacuucuaccaggagagcgccccgucccagagcgacguggcccugauccgguacgucaaccccgacacggggcgcacccucuucgaggcgaagcugcaccgcuccggcuacaucaccguggcccacagcggggacuacccccuggugguccccgccaacggccacuuccgguucgacuccugguga

SEQ ID NO: 12947 - RNA, 1563 nt, Artificial Sequence
  derived and/or modified sequence opt1 from VP1__Norovirus_and/or_Norovirus-like__KT864684
augaagauggccagcuccgacgccgcgcccagcaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacuccaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugucccagcgcaacgucgggaacgacgcccccggcagcacccgggcccagcaggcgugggugagcacguacagcccccaguucgugccgaagcugggcuccgucaaccuccgcaucuccgacaacgacgacuuccaguuccagcccaccaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcaucaucgacugccugaucccccaggaguggauccagcacuucuaccaggaguccgcccccagccaguccgacguggcccugauccgguacgucaacccggacacggggcgcacccucuucgaggcgaagcugcaccgcagcggcuacaucaccguggcccacuccggggacuacccccuggugguccccgccaacggccacuuccgguucgagagcugguga

SEQ ID NO: 12948 - RNA, 1563 nt, Artificial Sequence
  derived and/or modified sequence opt1 from VP1__Norovirus_and/or_Norovirus-like__KX764836
augaagauggccagcuccgacgccgcgcccagcaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacuccaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugucccagcgcaacgucgggaacgacgcccccggcagcacccgggcccagcaggcgugggugagcacguacagcccccaguucgugccgaagcugggcuccgucaaccuccgcaucuccgacaacgacgacuuccaguuccagcccaccaaguucacccccgugggggugaacgacgacgacgacggccaccccuuccggcagugggagcugccgaacuacagcggggagcugacccucaacaugaaccuggccccgcccgucgcccccaacuuccccggcgagcagcuccuguucuuccgcuccuucgugcccugcagcgggggcuacaaccagggcgugaucgacugccugaucccccaggaguggauccagcacuucuaccaggaguccgcccccagccaguccgacgucgcccugauccgguacgugaacccggacacggggcgcacccucuucgaggcgaagcugcaccgcagcggcuacaucaccguggcccacuccggggacuacccccuggucgugcccgccaacggccacuuccgguucgaggccugguga

SEQ ID NO: 12949 - RNA, 1563 nt, Artificial Sequence
  derived and/or modified sequence opt1 from VP1__Norovirus_and/or_Norovirus-like__KX764845
augaagauggccagcuccgacgccgcgcccagcaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacuccaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccagcuccugccgagcggcaucugcgcguuccgcggccgggucaccgcccagaucaaccagcgcgaccgguggcacaugcagcugcagaaccucaacgggaccacguacgaccccaccgacgacgugcccgccccgcugggcacccccgacuucaaggggguggucuucggcauggugucccagcgcaacgucgggaacgacgcccccggcagcacccgggcccagcaggcgugggugagcacguacucccugcaguucgugcccaagcucggcagcgucaaccugcgcaucuccgacaacgacgacuuccaguuccagccgaccaaguucacccccgugggggugaacgacgacgacgacggccaccccuuccggcagugggagcugcccaacuacagcggggagcucacccugaacaugaaccuggccccgcccgucgcccccaacuuccccggcgagcagcuccuguucuuccgcuccuucgugccgugcagcgggggcuacaaccagggcaucaucgacugccugaucccccaggaguggauccagcacuucuaccaggaguccgcccccagccaguccgacguggcccucauccgguacgucaaccccgacacggggcgcacccuguucgaggcgaagcugcaccgcagcggcuacaucaccguggcccacuccggggacuacccgcucgugguccccgccaacggccacuuccgguucgaggccugguga

SEQ ID NO: 12950 - RNA, 1563 nt, Artificial Sequence
  derived and/or modified sequence opt1 from VP1__Norovirus_and/or_Norovirus-like__KX764837
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcugccgcguccugacgcggccgacccccgacuucgaguucaccuaccucgugccgcccuccguggagagcaagaccaagcccuucucccugcccauccugacgcucagcgagcugaccaacucccgcuuccccguccccaucgacagccuguucaccgcccagaacaacgugcuccaggugcagugccagaacgggcggugcacccuggacggcgagcugcagggggcgacgcagcuccugccguccggcaucugcgccuuccgcggccgggucaccgcccagaucaaccagcgcgaccgguggcacaugcagcugcagaaccucaacgggaccaccuacgaccccacggacgacgugcccgccccgcugggcacccccgacuucaaggggguggucuucggcauggugagccagcgcaacgucgggaacgacgugcccggcuccacccgggcccagcaggcgugggugagcaccuacagcccccaguucgucccgaagcugggcuccgugaaccuccgcaucagcgacaacgacgacuuccaguuccagcccacgaaguucacccccgugggggucaacgacgacgacgacggccaccccuuccggcagugggagcugccgaacuacuccggggagcugacccucaacaugaaccuggccccgcccguggcccccaacuuccccggcgagcagcuccuguucuuccgcagcuucgugcccugcuccgggggcuacaaccagggcgucaucgacugccugaucccccaggaguggauccagcacuucuaccaggagagcgcccccucccagagcgacguggcccugauccgguacgugaacccggacaccgggcgcacccucuucgaggcgaagcugcaccgcuccggcuacaucaccgucgcccacagcggggacuacccccugguggugcccgccaacggccacuuccgguucgacgccugguga

SEQ ID NO: 12951 - RNA, 1563 nt, Artificial Sequence
  derived and/or modified sequence opt1 from VP1__Norovirus_and/or_Norovirus-like__KX764838
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucagccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacuccaaccagcccaacagccggaugcgccuggucgccaugcucuacacgccccugcgguccaacggcagcggcgacgacguguucaccguguccugccgcguccugacccggccgacccccgacuucgaguucaccuaccucgugccgcccagcguggaguccaagaccaagcccuucagccugcccauccugacgcucuccgagcugaccaacagccgcuuccccguccccaucgacucccuguucaccgcccagaacaacgugcuccaggugcagugccagaacgggcggugcacccuggacggcgagcugcaggggacgacccaggucgugccgagcggcaucugcgcguuccgcggccgggugaccgcccagaucaaccagcgcgaccgguggcacaugcagcuccagaaccugaacuccaccacguacgaccccaccgacgacguccccgccccgcuggggacccccgacuucaagggcguggucuucgggauggugagccagcgcaacgugggcaacgacgcccccgggagcacccgggcccagcaggcgugggucuccacguacagcccccaguucgugccgaagcucggcuccgugaaccugcgcaucagcgacaacgacgacuuccaguuccagcccaccaaguucacccccgucggcgugaacgacgacgacgacgggcaccccuuccggcagugggagcugccgaacuacuccggcgagcucacccugaacaugaaccuggccccgcccguggcccccaacuuccccggggagcagcuccuguucuuccgcagcuucguccccugcuccggcggguacaaccagggcaucaucgacugccugaucccccaggaguggauccagcacuucuaccaggagagcgcccccucccagagcgacguggcccucauccgguacgugaacccggacacgggccgcacccuguucgaggcgaagcugcaccgcuccggguacaucgccgucgcccacagcggcgacuacccccucguggugcccgccaacgggcacuuccgguucgacuccugguga

SEQ ID NO: 12952 - RNA, 1563 nt, Artificial Sequence
  derived and/or modified sequence opt1 from VP1__Norovirus_and/or_Norovirus-like__KU687016
augaagauggccagcaacgacgccgcgcccuccaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugagccgcauguacaacggguacgccggcgggguggaggugcagguccuccuggccggcaacgccuucaccgccgggaagauccuguucgcggccgugccgcccaacuuccccguggaguuccucucccccgcccagaucaccaugcugccccaccugaucgucgacgugcggacgcucgagcccaucaugaucccgcugcccgacgugcgcaacaccuucuuccacuacagcaaccagcccaacucccggaugcgccuggucgccaugcucuacacgccccugcggagcaacggcuccggcgacgacguguucaccgugagcuuccgcguccugacccggccgacccccgacuucgaguucaccuaccucgugccgcccuccguggagagccgcaccaagcccuucucccugcccauccugacgcucagcgagcugaccaacucccgguuccccguccccaucgacagccuguucaccgcccagaacaacgugcuccaggugcagugccagaacgggcgcugcacccuggacggcgagcugcaggggacgacccagcuccugccguccggcaucugcgcguuccggggccaggucaccgcccagaucaaccagcgcgaccgguggcacaugcagcugcagaaccucaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcugggcuccaucaaccuccgcaucagcgacaacgacgacuuccaguuccagcccaccaaguucacccccgucggggugaacgacgacgacgacggccaccccuuccggcagugggagcugccgaacuacuccggggagcugacccucaacaugaaccuggccccgcccguggcccccaacuuccccggcgagcagcuccuguucuuccgcagcuucguccccugcuccgggggcuacaaccagggcaucaucgacugccugaucccccaggaguggauccagcacuucuaccaggagagcgcccccucccagagcgacguggcccugauccgguacgugaacccggacacggggcgcacccucuucgaggcgaagcugcaccgcuccggcuacaucaccgucgcccacagcggggacuacccccugguggugcccgccaacggccacuuccgguucgacgccugguga

SEQ ID NO: 12953 - RNA, 1563 nt, Artificial Sequence
  derived and/or modified sequence opt1 from VP1__Norovirus_and/or_Norovirus-like__KU687015
augaagauggccagcuccgacgccgcgcccagcaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugucccgcauguacaacggguacgccggcgggguggaggugcagguccuccuggccggcaacgccuucaccgccgggaagauccuguucgcggccgugcuccccaacuuccccguggaguuccugagcccggcccagaucaccaugcugccccaccucaucgucgacgugcggacgcuggagcccaucaugaucccccugccggacgugcgcaacaccuucuuccacuacuccaaccagcccaacagccggaugcgccucgucgccaugcuguacacgccccugcgguccaacggcagcggcgacgacguguucaccguguccugccgcguccucacccggcccaccccggacuucgaguucaccuaccuggugccgcccagcguggaguccaagaccaagcccuucagccugcccauccucacgcuguccgagcugaccaacagccgcuuccccguccccaucgacccccucuucaccgcccagaacaacgugcuccaggugcagugccagaacgggcggugcacccuggacggcgagcugcaggggacgacccagcugcugccguccggcaucugcgcguuccgcggccgggucaccgcccagaucaaccagcgcgaccgguggcacauccagcuccagaaccugaacgggaccacguacgaccccaccgacgacgugcccgccccgcugggcacccccgacuucaaggggguggucuucggcauggugagccagcgcaacgucgggaacgacgcccccggcuccacccgggcccagcaggcgugggugagcacguacagcccccaguucgugccgaagcucggcuccaucaaccugcgcaucagcgacaacgacgacuuccaguuccagcccaccaaguucacccccgucggggugaacgacgacgacgacggccaccccuuccggcagugggagcugccgaacuacuccggggagcucacccugaacaugaaccuggccccgcccguggcccccaacuuccccggcgagcagcuccuguucuuccgcagcuucguccccugcuccgggggcuacaaccagggcaucaucgacugccugaucccccaggaguggauccagcacuucuaccaggagagcgcccccucccagagcgacguggcccucauccgguacgugaacccggacacggggcgcacccuguucgaggcgaagcugcaccgcuccggcuacaucaccgucgcccacagcggggacuacccccucguggugcccgccaacggccacuuccgguucgacgccugguga

SEQ ID NO: 12954 - RNA, 1563 nt, Artificial Sequence
  derived and/or modified sequence opt1 from VP1__Norovirus_and/or_Norovirus-like__KU687013
augaagauggccagcuccgacgccgcgcccagcaacgacggcgccgccgggcuggugccggagggcaacaacgagacccucccccuggagcccgucgccggggccgcgaucgccgcccccgugaccggccagaacaacaucaucgacccguggauccgcacgaacuucgugcaggcccccaacggggaguucaccgucagcccccggaacucccccggcgagauccugcucaaccuggagcugggcccggaccucaaccccuaccuggcgcaccugucccgcauguacaacggguacgccggcgggguggaggugcagguccuccuggccggcaacgccuucaccgccgggaagauccuguucgcggccgugccgcccaacuuccccguggaguuccucagccccgcccagaucaccaugcugccccaccugaucgucgacgugcggacgcucgagcccaucaugaucccgcugcccgacgugcgcaacaccuucuuccacuacuccaaccagcccaacagccggaugcgccuggucgccaugcucuacacgccccugcgguccaacggcagcggcggggacguguucaccguguccugccgcguccugacccggccgacccccgacuucgaguucaccuaccucgugccgcccagcgugaaguccaagaccaagcccuucagccugcccauccugacgcucuccgagcugaccaacagccgcuuccccguccccaucgacucccuguucaccgcccagaacaacgugcuccaggugcagugccagaacggccggugcacccuggacggggagcugcagggcacgacccagcuccugccgagcggcaucugcgcguuccgcgggcgggucaccgcccagaucaaccagcgcgaccgguggcacaugcagcugcagaaccucaacggcaccacguacgaccccaccgacgacgugcccgccccgcuggggacccccgacuucaagggcguggucuucgggauggugucccagcgcaacgucggcaacgacgcccccggcagcacccgggcccagcaggcgugggugagcacguacagcccccaguucgugccgaagcugggguccaucaaccuccgcaucuccgacaacgacgacuuccaguuccagcccaccaaguucacccccgucggcgugaacgacgacgacgacgggcaccccuuccggcagugggagcugccgaacuacagcggcgagcugacccucaacaugaaccuggccccgcccguggcccccaacuuccccggggagcagcuccuguucuuccgcuccuucguccccugcagcggcggcuacaaccaggggaucaucgacugccugaucccccaggaguggauccagcacuucuaccaggaguccgcccccagccaguccgacguggcccugauccgguacgugaacccggacacgggccgcacccucuucgaggcgaagcugcaccgcagcggguacaucaccgucgcccacuccggcgacuacccccugguggugcccgccaacgggcacuuccgguucgagagcugguga

SEQ ID NO: 12955 - RNA, 1563 nt, Artificial Sequence
  derived and/or modified sequence opt1 from VP1__Norovirus_and/or_Norovirus-like__KX764839
augaagauggccagcuccgacgccgcgcccagcaacgacggcgccgccgggcuggugccggagggcaacaacgagacccucccccuggagcccgucgccgggaccgccaucgcggcccccgugacgggccagaacaacaucaucgacccguggauccgcaccaacuucgugcaggcccccaacggggaguucaccgucagcccccggaacucccccggcgagauccugcucaaccuggagcugggcccggaccucaaccccuaccuggcccaccugucccgcauguacaacggguacgcgggcgggguggaggugcagguccuccuggccggcaacgccuucaccgccgggaagauccuguucgccgcggugccgcccaacuuccccguggaguuccucagccccgcccagaucacgaugcugccccaccugaucgucgacgugcggacccucggccccaucaugaucccgcugcccgacgugcgcaacaccuucuuccacuacuccaaccagcccaacagccggaugcgccuggucgccaugcucuacacgccccugcgguccaacggcagcggggacgacguguucaccguguccugccgcguccugacccggccgacccccgacuucgaguucaccuaccucgugccgcccagcguggaguccaagacgaagcccuucagccugcccauccugacccucuccgagcugaccaacagccgcuuccccguccccaucgacucccuguucaccgcccagaacaacgugcuccaggugcagugccagaacggccggugcacgcuggacggggagcugcagggcaccacccagcuccugccgagcggcaucugcgccuuccgcgggcgggucaccgcgcagaucaaccagcgcgaccgguggcacaugcagcugcagaaccucaacggcacgaccuacgaccccaccgacgacgugcccgccccgcuggggacccccgacuucaagggcguggucuucgggauggugucccagcgcaacgucggcaacgacgcccccggcagcacgcgggcccagcaggccugggugagcaccuacagcccccaguucgugccgaagcugggguccgucaaccuccgcaucuccgacaacgacgacuuccaguuccagcccaccaaguucacccccgugggcgugaacgacgacgacgacgggcaccccuuccggcagugggagcugccgaacuacagcggcgagcugacgcucaacaugaaccuggcgccgcccgucgcccccaacuuccccggggagcagcuccuguucuuccgcuccuucgugcccugcagcggcggcuacaaccaggggaucaucgacugccugaucccccaggaguggauccagcacuucuaccaggaguccgcccccagccaguccgacguggcccugauccgguacgucaacccggacaccggccgcacccucuucgaggccaagcugcaccgcagcggguacaucaccguggcgcacuccggcgacuacccccuggugguccccgccaacgggcacuuccgguucgaggccugguga

SEQ ID NO: 12956 - RNA, 1563 nt, Artificial Sequence
  derived and/or modified sequence opt1 from VP1__Norovirus_and/or_Norovirus-like__KX764844
augaagauggccagcaacgacgccgcgcccuccaacgacggcgccgccgggcuggugccggagggcaacaacgggacccucccccuggagcccgucgccggcgccgcgaucgccgcccccgugaccgggcagaacaacaucaucgacccguggauccgcaucaacuucgugcaggcccccaacggcgaguucacggucagcccccggaacucccccggcgagauccugcucaaccuggagcuggggccggaccucaaccccuaccuggcgcaccugagccgcauguacaacggcuacgccgggggcguggaggugcagguccuccuggccgggaacgccuucaccgccggcaagauccuguucgcggccgugccgcccaacuuccccguggaguuccucucccccgcccagaucaccaugcugccccaccugaucgucgacgugcggacccucgagcccaucaugaucccgcugcccgacgugcgcaacacguucuuccacuacagcaaccagcccaacucccggaugggccuggucgccaugcucuacacgccccugcgcagcaacggguccggcgacgacguguucaccgugagcugccggguccugacccgcccgacgcccgacuucgaguucaccuaccucgugccgcccuccguggagagcaagaccaagcccuucucccugcccauccugacccucagcgagcugacgaacucccgguuccccguccccaucgacagccuguucaccgcccagaacaacgugcuccaggugcagugccagaacgggcgcugcacccuggacggcgagcugcagggcaccacgcagcuccugccguccgggaucugcgcguuccggggccgcgucaccgcccagaucaaccagcgggaccgcuggcacaugcagcugcagaaccucaacgggaccaccuacgaccccacggacgacgugcccgccccgcugggcacccccgacuucaaggggguggucuucggcauggugagccagcggaacgucggcaacgacgcccccggguccacccgcgcccagcaggcgugggugagcaccuacagcccccaguucgugccgaagcugggcuccgucaaccuccggaucagcgacaacgacgacuuccaguuccagcccacgaaguucacccccgugggggugaacgacgacgacgacggccaccccuuccgccagugggagcugccgaacuacuccggggagcugacccucaacaugaaccuggccccgcccgucgcccccaacuuccccggcgagcagcuccuguucuuccggagcuucgugcccugcuccggcggguacaaccagggcaucaucgacugccugaucccccaggaguggauccagcacuucuaccaggagagcgcccccucccagagcgacguggcccugauccgcuacgucaacccggacaccgggcggacccucuucgaggcgaagcugcaccgcuccggcuacaucaccguggcccacagcggggacuacccccuggugguccccgccaacggccacuuccgcuucgaguccugguga

SEQ ID NO: 12957 - RNA, 1563 nt, Artificial Sequence
  derived and/or modified sequence opt1 from VP1__Norovirus_and/or_Norovirus-like__KT864686
augaagauggccagcuccgacgccgcgcccagcaacgacggcgccgccgggcuggugccggagggcaacaacgagacccucccccuggagcccgucgugggggccgccaucgcggcccccgugaccggccagaacaacaucaucgacccguggauccgcacgaacuucguccaggcccccaacggggaguucaccgugagcccccggaacucccccggcgagauccugcucaaccuggagcugggcccggaccucaaccccuaccuggcccaccugucccgcauguacaacggguacgcgggcgggguggagguccaggugcuccuggccggcaacgccuucaccgccgggaagauccuguucgccgcggugccgcccaacuuccccgucgaguuccucagccccgcccagaucaccaugcugccccaccugaucguggacgugcggacgcucgagcccaucaugaucccgcugcccgacguccgcaacaccuucuuccacuacuccaaccagcccaacagccggaugcgccugguggccaugcucuacacgccccugcgguccgacggcagcggcgacgacguguucaccgucuccugccgcgugcugacccggccgacccccgacuucgaguucaccuaccucgugccgcccagcgucgaguccaagaccaagcccuucagccugcccauccugacgcucuccgagcugaccaacagccgcuuccccgugcccaucgacucccuguucaccgcccagaacaacgugcuccagguccagugccagaacgggcggugcacccuggacggcgagcugcaggggacgacccagcuccugccgagcggcaucugcgccuuccgcggccgggugaccgcgcagaucaaccagcgcgaccgguggcacaugcagcugcagaaccucaacgggaccacguacgaccccaccgacgacgugcccgccccgcugggcacccccgacuucaagggggucguguucggcauggucucccagcgcaacguggggaacgacgcccccggcagcacccgggcccagcaggccugggugagcacguacagcccccaguucgucccgaagcugggcuccgugaaccuccgcaucuccgacaacgacgacuuccaguuccagcccaccaaguucacccccgugggggucaacgacgacgacgacggccaccccuuccggcagugggagcugccgaacuacagcggggagcugacccucaacaugaaccuggcgccgcccguggcccccaacuuccccggcgggcagcuccuguucuuccgcuccuucgugcccugcagcggcggcuacaaccaggggaucaucgacugccugaucccccaggaguggauccagcacuucuaccaggaguccgcccccagccaguccgacgucgcccugauccgguacgugaacccggacacgggccgcacccucuucgaggccaagcugcaccgcagcggguacaucaccguggcgcacuccggcgacuacccccuggucgugcccgccaacgggcacuuccgguucgagagcugguga

SEQ ID NO: 12958 - RNA, 1563 nt, Artificial Sequence
  derived and/or modified sequence opt1 from VP1__Norovirus_and/or_Norovirus-like__KU687012
augaagauggccagcuccgacgccgcgcccagcaacgacggcgccgccgggcuggucccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugucccgcauguacaacggcuacgccgggggcguggaggugcagguccugcucgccgggaacgccuucaccgccggcaagauccuguucgcggccgugccgcccaacuuccccguggacaugcugagccccgcccagaucaccaugcucccccaccugacggucgacgugcggacccuggagcccaucaugaucccgcuccccgacgugcgcaacgucuucuaccacuucaacaaccagcccgcgccccggaugcgccugguggccaugcuguacaccccgcuccgguccaacgggagcggcgacgacguguucaccgucuccugccgcgugcugacgcggcccacccccgacuucgaguucaccuaccuggugcccccgagcgucgaguccaagaccaagcccuucacgcuccccauccugaccaucggcgagcugaccaacagccgcuuccccgccccgaucgaccagcucuacaccucccccaacacggacauccuggugcagccccagaacgggcggugcacccuggacggcgagcuccaggggaccacccagcugcugacgaccgccaucugcagcuaccgcggcaccaccuccaacccgacgagcgacuacugggacgaccaccuccugcaccuggugcaccccaacggcgccaccuacgaccccaccgaggacguccccgccccguucgggacccaggacuuccggggcauccucuacggggugcugacgcagaacacccagagcccccgcgacgagguguccaacucccggggcaucuacaucagcagcaccuccgacaaguucacccccaagcuggggacgaucggccuccaccagguccagggcgacaccgccagcaaccagcaguccaaguucacccccguggggaucgcggucaaccagaacaccccguucaagcagugggagcugcccaacuacagcggcgcccugacgcucaacaccaaccuggcccccgccguggggcccaacuucccgggcgagcagauccuguucuuccgcuccaacgugcccagcguccaggggacccaccccacccaggagaucgacugccucaucccccaggaguggaucucccacuucuaccaggagagcgccccgucccagagcgacguggcgcuggugcgguacgucaaccccgacaccggccgcacgaucuucgaggccaagcugcaccggcagggcuucaucaccaucgccgccaccggguccaaccccgugguggugcccccgaacggcuacuuccgcuucgacagcugguga

SEQ ID NO: 12959 - RNA, 1563 nt, Artificial Sequence
  derived and/or modified sequence opt1 from VP1__Norovirus_and/or_Norovirus-like__KU687018
augaagauggccagcaacgacgccgcgcccuccaacgacggcgccgccgggcuggucccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugagccgcauguacaacggcuacgcccgcgggguggaggugcagguccugcucgccggcaacgccuucaccgccgggaagauccuguucgcggccgugccgcccaacuuccccguggacaugcugucccccgcccagaucaccaugcucccccaccugaucgucgacgugcggacgcuggagcccaucaugaucccgcuccccgacgugcggaacgucuucuaccacuucaacaaccagcccgcgccccgcaugcggcugguggccaugcuguacaccccgcuccgcagcaacggcuccggggacgacguguucaccgucagcugccgggugcugacccgccccacgcccgacuucgaguucaccuaccuggugcccccguccgucgagagcaagaccaagcccuucacccuccccauccugacgaucggcgagcugaccaacucccgguuccccgccccgaucgaccagcucuacaccagccccaacgccgacguggugguccagccccagaacggccgcugcacccuggacggggagcugcagggcacgacccagcuccugaccaccgccaucugcuccuaccgggggacgaccagcaacccgaccuccgacuacugggacgaccaccuccugcaccuggugcaccccaacggcgccaccuacgaccccacggaggacgugcccgccccguucggcacccaggacuuccgcgggauccuguacggcguccucacccagaacacccagaacccccgggacgaggugagcaacucccgcgggaucuacaucagcuccacgagcgacaaguucacccccaagcugggcaccaucgggcugcaccagguccagggcgacaccgcgagcaaccagcaguccaaguucacgcccgugggcaucgccgugaaccagaacaccccguucaagcagugggagcuccccaacuacagcggggcccugacccugaacaccaaccucgcccccgccgucggccccaacuucccgggggagcagauccuguucuuccgguccaacgugcccagcgugcagggcaaccaccccacgcaggagaucgacugccugaucccccaggagugggucucccacuucuaccaggagagcgcgccgucccagagcgacguggcccucgugcgcuacgucaaccccgacaccgggcggaccaucuucgaggccaagcugcaccgccagggcuucaucaccaucgccgcgaccggcuccaaccccgugguggugcccccgaacggguacuuccgguucgagagcugguga

SEQ ID NO: 12960 - RNA, 1563 nt, Artificial Sequence
  derived and/or modified sequence opt1 from VP1__Norovirus_and/or_Norovirus-like__KU687021
augaagauggccagcaacgacgccacccccuccaacgacggcgcggccgggcuggucccggagaucaacaccgagacgcucccccuggagcccgucgccggcgccgccaucgcggcccccgugaccgggcagaacaacaucaucgacccguggauccgcaacaacuucgugcaggcccccaacggcgaguucaccgucagcccccggaacucccccggggagauccugaugaaccucgagcugggcccggaccugaaccccuaccucgcccaccugagccgcauguacaacggcuacgccgggggcguggaggugcagguccugcucgccgggaacgccuucaccgccggcaagauccuguucgccgcggugccgcccaacuuccccguggacaugcugucccccgcccagaucacgaugcucccccaccugaucgucgacgugcggacccuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacgcggcccacccccgacuucgaguucaccuaccuggugcccccguccgucgagagcaagaccaagcccuucacgcuccccauccugaccaucggcgagcugaccaacucccgcuuccccgccccgaucgaccagcucuacaccagccccaacgcggacguggugguccagccccagaacgggcggugcacgcuggacggcgagcugcaggggaccacccagcuccugaccacggccaucugcuccuaccgcggcaccaccagcaacccgaccuccgacuacugggacgaccaccuccugcaccuggugcaccccaacggcgccacguacgaccccaccgaggacgugcccgccccguucgggacccaggacuuccggggcauccuguacgggguccucacccagaacacgcagaacccccgcgacaaggugagcaacucccggggcaucuacaucagcuccaccagcgacaaguucacccccaagcuggggaccaucggccugcaccagguccagggcgacacggccagcaaccagcaguccaaguucacccccguggggaucgcggugaaccagaacaccccguucaagcagugggagcuccccaacuacagcggcgcccugacccugaacacgaaccucgcccccgccgucgggcccaacuucccgggcgagcagauccuguucuuccgcuccaacgugcccagcgugcaggggaaccaccccacccaggagaucgacugccugaucccccaggagugggucucccacuucuaccaggagagcgccccgucccagagcgacguggcgcucgugcgguacgucaaccccgacaccggccgcaccaucuucgaggccaagcugcaccggcagggcuucaucaucaucgccgccaccggguccaaccccgugguggugcccccgaacggcuacuuccgcuucgagagcugguga

SEQ ID NO: 12961 - RNA, 1563 nt, Artificial Sequence
  derived and/or modified sequence opt1 from VP1__Norovirus_and/or_Norovirus-like__KU687020
augaagauggccagcuccgacgccgcgcccagcaacgacggcgccgccgggcuggucccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugucccgcauguacaacggcuacgccgggggcguggaggugcagguccugcucgccgggaacgccuucaccgccggcaagauccuguucgcggccgugccgcccaacuuccccguggacaugcugagccccgcccagaucaccaugcucccccaccugaucgucgacgugcggacgcuggagcccaucaugaucccgcuccccgacgugcgcaacgucuucuaccacuucaacaaccagcccgcgccccggaugcgccugguggccaugcuguacaccccgcuccgguccaacgggagcggcgacgacguguucaccgucuccugccgcgugcugacccggcccacgcccgacuucgaguucaccuaccuggugcccccgagcgucgaguccaagaccaagcccuucacccuccccauccugacgaucggcgagcugaccaacagccgcuuccccgccccgaucgaccagcucuacgccucccccaacgccgacguggugguccagccccagaacgggcggugcacccuggacggcgagcugcaggggaccacgcagcuccugaccaccgccaucugcagcuaccgcggcaccacguccaacccgaccagcgacuacugggacgaccaccuccugcaccuggugcaccccaacggcgccaccuacgaccccaccgaggacgugcccgcgccguucgggacgcaggacuuccggggcauccuguacgggguccucacccagaacacccagaacccccgcgacgagguguccaacagccggggcaucuacaucuccagcaccagcgacaaguucacgcccaagcuggggaccaucggccugcaccagguccagggcgacaccgccuccaaccagcagagcaaguucacccccguggggaucgccgugaaccagaacacgccguucaagcagugggagcuccccaacuacuccggcgcccugacccugaacaccaaccucgcccccgcggucgggcccaacuucccgggcgagcagauccuguucuuccgcagcaacgugcccuccgugcaggggaaccaccccacccaggagaucgacugccugaucccccaggagugggucagccacuucuaccaggaguccgccccgagccaguccgacguggcccucgugcgguacgucaaccccgacacgggccgcaccaucuucgaggccaagcugcaccggcagggcuucaucaccaucgcggccaccgggagcaaccccgugguggugcccccgaacggcuacuuccgcuucgacgccugguga

SEQ ID NO: 12962 - RNA, 1563 nt, Artificial Sequence
  derived and/or modified sequence opt1 from VP1__Norovirus_and/or_Norovirus-like__KU687014
augaagauggccagcaacgacgccgcgcccuccaacgacggcgccgccgggcuggugccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugagccgcauguacaacggcuacgccgggggcguggaggugcagguccugcucgccgggaacgccuucaccgccggcaagauccuguucgcggccgugccgcccaacuuccccguggacaugcugauccccgcccagaucaccaugcucccccaccugaucgucgacgugcggacgcuggagcccaucaugaucccgcuccccgacgugcgcaacgucuucuaccacuucaacaaccagcccgcgccccggaugcgccugguggccaugcuguacaccccgcuccgguccaacgggagcggcgacgacguguucaccgucuccugccgcgugcugacccggcccacgcccgacuucgaguucaccuaccuggugcccccgagcgucgaguccaagaccaagcccuucacccuccccauccugacgaucggcgagcugaccaacagccgcuuccccgccccgaucgaccagcucuacaccucccccaacgccgacguggugguccagccccagaacgggcggugcacccuggacggcgagcugcaggggacgacccagcuccugaccaccgccaucugcagcuaccgcggcacgaccuccaacccgaccagcgacuacugggacgaccaccuccugcaccuggugcaccccaacggcgccaccuacgggcccacggaggacgugcccgccccguucggcacccaggacuuccgggggauccuguacggcguccucacccagaacacccagaacccccgcgacgagguguccaacagccgggggaucuacaucuccagcacguccgacaaguucacccccaagcugggcaccaucggccugcaccagguccagggggacaccgcgagcaaccagcagagcaaguucacgcccgugggcaucgccgugaaccagaacaccccguucaagcagugggagcuccccaacuacuccggggcccugacccugaacaccaaccucgcccccgccgucggccccaacuucccgggggagcagauccuguucuuccgcagcaacgugcccuccgugcagggcacgcaccccacccaggagaucgacugccugaucccccaggaguggaucagccacuucuaccaggaguccgcgccgagccaguccgacgucgcccucgugcgguacgugaaccccgacaccggccgcaccaucuucgaggccaagcugcaccggcagggguucaucaccaucgccgcgacgggcagcaaccccgucguggugcccccgaacggguacuuccgcuucgacgccugguga

SEQ ID NO: 12963 - RNA, 1563 nt, Artificial Sequence
  derived and/or modified sequence opt1 from VP1__Norovirus_and/or_Norovirus-like__KU687019
augaagauggccagcaacgacgccgcgcccuccaacgacggcgccgccgggcuggucccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugagccgcauguacaacggcuacgccgggggcguggaggugcagguccugcucgccgggaacgccuucaccgccggcaagauccuguucgcggccgugccgcccaacuuccccguggacaugcugucccccgcccagaucaccaugcucccccaccugaucgucgacgugcggacgcuggagcccaucaugaucccgcuccccgacgugcgcaacgucuucuaccacuucaacaaccagcccgcgccccggaugcgccugguggccaugcuguacaccccgcuccggagcaacggguccggcgacgacguguucaccgucagcugccgcgugcugacccggcccacgcccgacuucgaguucaccuaccuggugcccccguccgucgagagcaagaccaagcccuccacccuccccauccugacgaucggcgagcugaccaacagccgcuuccccgccccgaucgaccagcucuacaccucccccaacgccgacguggugguccagccccagaacgggcggugcacccuggacggcgagcugcaggggacgacccagcuccugaccaccgccaucugcagcuaccgcggcacgaccuccaacccgaccagcgacuacugggacgaccaccuccugcaccuggugcaccccaacggcgccaccuacgaccccacggaggacgugcccgccccguucgggacccaggacuuccggggcauccuguacgggguccucacccagaacacccagaacccccgcgacgagguguccaacagccggggcaucuacaucuccagcacgagcgacaaguucacccccaagcuggggaccaucggccugcaccagguccagggcgacaccgcguccaaccagcagagcaaguucacgcccguggggaucgccgugaaccagaacaccccguucaagcagugggagcuccccaacuacuccggcgcccugacccugaacaccgaccucgcccccgccgucgggcccaacuucccgggcgagcagauccuguucuuccgcagcaacgugcccuccgugcaggggaaccaccccacgcaggagaucgacugccugaucccccaggagugggucagccacuucuaccaggaguccgcgccgagccaguccgacguggcccucgugcgguacgucaaccccgacaccggccgcaccaucuucgaggccaagcugcaccggcagggcuucaccaccaucgccgcgacggggagcaaccccgugguggugcccccgaacggcuacuuccgcuucgaguccugguga

SEQ ID NO: 12964 - RNA, 1563 nt, Artificial Sequence
  derived and/or modified sequence opt1 from VP1__Norovirus_and/or_Norovirus-like__KU687017
augaagauggccagcuccgacgccgcgcccagcaacgacggcgccgccgggcuggugccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugucccgcauguacaacggcuacgccgggggcguggaggugcagguccugcucgccgggaacgccuucaccgccggcaagauccuguucgcggccgugccgcccaacuuccccguggacaugcugagccccgcccagaucaccaugcucccccaccugaucgucgacgugcggacgcuggagcccaucaugaucccgcuccccgacgugcgcaacgucuucuaccacuucaacaaccagcccgcgccccggaugcgccugguggccgugcuguacaccccgcuccgguccaacgggagcggcgacgacgucuucaccguguccugccgcgugcugacccggcccacgcccgacuucgaguucaccuaccuggugcccccgagcgucgaguccaagaccaagcccuucacccuccccauccugacgaucggcgagcugaccaacagccgcuuccccgccccgaucgaccagcucuacaccucccccaacgccgacguggucgugcagccccagaacgggcggugcacccuggacggcgagcugcaggggacgacccagcuccugaccaccgccaucugcagcuaccgcggcacgaccuccaacccgaccagcgacuacugggacgaccaccuccugcaccuggugcaccccaacggcgccaccuacgaccccacggaggacguccccgccccguucgggacccaggacuuccggggcauccuguacggggugcucacccaggacacccagaacccccgcgacgaggucuccaacagccggggcaucuacaucuccagcacgagcgacaaguucacccccaagcuggggaccaucggccugcaccaggugcagggcgacaccgcguccaaccagcagagcaaguucacgcccguggggaucgccgucaaccagaacaccccguucaagcagugggagcuccccaacuacuccggcgcccugacccugaacaccaaccucgcccccgccguggggcccaacuucccgggcgagcagauccuguucuuccgcagcaacgugcccuccguccaggggaaccaccccacgcaggagaucgacugccugaucccccaggagugggugagccacuucuaccaggaguccgcgccgagccaguccgacguggcccucguccgguacgugaaccccgacgccggccgcaccaucuucgaggccaagcugcaccggcagggcuucaucaccaucgcggccaccgggagcaaccccguggucgugcccccgaacggcuacuuccgcuucgaggccugguga

SEQ ID NO: 12965 - RNA, 1563 nt, Artificial Sequence
  derived and/or modified sequence opt1 from VP1__Norovirus_and/or_Norovirus-like__KU687024
augaagauggccagcuccgacgccgcgcccagcaacgacggcgccgccgggcuggucccggagaucaacaccgagacccucccccuggagcccgucgccggcgccgcgaucgccgcccccgugacggggcagaacaacaucaucgacccguggauccgcaacaacuucgugcaggcccccaacggcgaguccaccgucagcccccggaacucccccggggagauccugaugaaccucgagcugggcccggaccugaaccccuaccucgcgcaccugagccgcauguacaacggcuacgccgggggcguggaggugcagguccugcucgccgggaacgccuucaccgccggcaagauccuguucgcggccgugccgcccaacuuccccguggacaugcugucccccgcccagaucaccaugcucccccaccugaucgucgacgugcggacgcuggagcccaucaugaucccgcuccccgacgugcgcaacgucuucuaccacuucaacaaccagcccgcgccccggaugcgccugguggccaugcuguacaccccgcuccggagcaacggggccggcgacgacguguucaccgucuccugccgcgugcugacccggcccacgcccgacuucgaguucaccuaccuggugcccccgagcgucgaguccaagaccaagcccuucacccuccccauccugacgaucggcgagcugaccaacagccgcuuccccgccccgaucgaccagcucuacaccucccccaacaccgacauccuggugcagccccagaacgggcggugcacgcuggacggcgagcuccaggggaccacccagcugcugaccacggccaucugcagcuaccgcggcaccaccuccaacccgaccagcgacuacugggacgaccaccuccugcaccuggugcaccccaacggcgccacguacgaccccaccgaggacguccccgccccguucgggacccaggacuuccggggcauccucuacggggugcugacccagaacacgcagaacccccgcgacgagguguccaacagccggggcaucuacaucuccagcaccagcgacaaguucacccccaagcuggggaccaucggccuccaccagguccagggcgacacggcguccaaccagcagagcaaguucacccccguggggaucgccgucaaccagaacaccccguucaagcagugggagcugcccaacuacuccggcgcccugacccucaacacgaaccuggcccccgccguggggcccaacuucccgggcgagcagauccuguucuuccgcagcaacgugcccuccguccaggggacccaccccacccaggagaucgacugccucaucccccaggaguggaucagccacuucuaccaggaguccgcgccgagccaguccgacguggcccuggugcgguacgucaaccccgacaccggccgcaccaucuucgaggccaagcugcaccggcagggcuucaucacgaucgccgcgaccgggagcaaccccgugguggugcccccgaacggcuacuuccgcuucgaggccugguga

SEQ ID NO: 12966 - RNA, 1563 nt, Artificial Sequence
  derived and/or modified sequence opt1 from VP1__Norovirus_and/or_Norovirus-like__KU687022
augaagauggccagcaacgacgccgcgcccuccaacgacggcgccgccgggcuggugccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccccagccgcauguacaacggcuacgccgggggcguggaggugcagguccugcuggccgggaacgccuucaccgccggcaagauccucuucgcggccgugcccccgaacuuccccguggacaugcugucccccacccagaucacgaugcugccccaccucaccgucgacgugcggacccuggagccgaucaugaucccccugcccgacgugcgcaacgucuucuaccacuucaacaaccagcccgccccgcggaugcgccucguggccaugcuguacacgccccugcggagcaacggguccggcgacgacgugcucaccgucagcugccgcgugcugacccggcccacccccgacuucgaguucaccuaccuggugccgcccuccgucgagagcaagacgaagcccuucacccuccccauccugaccaucggcgagcugaccaacucccgcuucccggcccccaucgaccagcucuacacgagccccaacgcggacguggugguccagccgcagaacgggcggugcacccuggacggcgagcugcaggggaccacccagcuccugacgaccgccaucugcuccuaccgcggcaccaccagcaaccccacguccgacuacugggacgaccaccuccugcaccuggugcaccccaacggcgccaccuacgaccccaccgaggacgugccggcccccuucgggacccaggacuuccggggcauccuguacgggguccucacgcagaacacccagaacccccgcgacgaggugagcaacucccggggcaucuacaucagcuccaccagcgacaaguucacccccaagcuggggacgaucggccugcaccagguccagggcgacaccgccagcaaccagcaguccaaguucaccccgguggggaucgcggugaaccagaacacccccuucaagcagugggagcuccccaacuacagcggcgcccugacgcugaacaccaaccucgcccccgccgucgggccgaacuuccccggcgagcagauccuguucuuccgcuccaacgugcccagcgugcaggggaaccaccccacccaggagaucgacugccugaucccgcaggagugggucucccacuucuaccaggagagcgcccccucccagagcgacguggcgcucgugcgguacgucaaccccgacaccggccgcaccaucuucgaggccaagcugcaccggcagggcuucaucacgaucgccgccaccggguccaaccccgugguggucccgcccaacggcuacuuccgcuucgagagcugguga

SEQ ID NO: 12967 - RNA, 1563 nt, Artificial Sequence
  derived and/or modified sequence opt1 from VP1__Norovirus_and/or_Norovirus-like__KU687023
augaagauggccagcuccgacgccgcgcccagcaacgacggcgccgccgggcuggucccggagaucaacaccgagacccucccccuggagcccgucgccggcgccgcgaucgccgcccccgugacggggcagaacaacaucaucgacccguggauccgcaacaacuucgugcaggcccccaacggcgaguucaccgucagcccccggaacucccccggggagauccugaugaaccucgagcugggcccggaccugaaccccuaccucgcgcaccugucccgcauguacaacggcuacgccgggggcguggaggugcagguccugcucgccgggaacgccuucaccgccggcaagauccuguucgcggccgugccgcccaacuuccccguggacaugcugagccccgcccagaucaccaugcucccccaccugaucgucgacgugcggacgcuggagcccaucaugaucccgcuccccgacgugcgcaacgucuucuaccacuucaacaaccagcccgcgccccggaugcgccugguggccaugcuguacaccccgcuccgguccaacgggagcggcgacgacguguucaccgucuccugccgcgugcugacccggcccacgcccgacuucgaguucaccuaccuggugcccccgagcgucgaguccaagaccaagcccuucacccuccccauccugacgaucggcgagcugaccaacagccgcuuccccgccccgaucgaccagcucuacaccucccccaacaccgacauccuggugcagccccagaacgggcggugcacgcuggacggcgagcuccaggggaccacccagcugcugaccacggccaucugcagcuaccgcggcaccaccuccaacccgaccagcgacuacugggacggccaccuccugcaccuggugcaccccaacggggccacguacgaccccaccgaggacguccccgccccguucggcacccaggacuuccgggggauccucuacggcgugcugacccagaacacgcagaacccccgcgacgagguguccaacagccgggggaucuacaucuccagcaccagcgacaaguucacccccaagcugggcaccaucggccuccaccagguccagggggacacggccuccaaccagcagagcaaguucacccccgugggcaucgcggucaaccagaacaccccguucaagcagugggagcugcccaacuacuccggggcccugacccucaacacgaaccuggcccccgccgugggccccaacuucccgggggagcagauccuguucuuccgcagcaacgugcccuccguccagggcacccaccccacccaggagaucgacugccucaucccccaggaguggaucagccacuucuaccaggaguccgccccgagccaguccgacguggcgcuggugcgguacgucaaccccgacaccggccgcaccaucuucgaggccaagcugcaccggcagggguucaucgccaucgccgcgacgggcagcaaccccgugguggugcccccgaacggguacuuccgcuucgaggccugguga

SEQ ID NO: 12968 - RNA, 1563 nt, Artificial Sequence
  derived and/or modified sequence opt1 from VP1__Norovirus_and/or_Norovirus-like__KX764847
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgaccccaccaucaagcugaucgccaugcucuacacgccccugcgggcgaacaacgccggcgacgacgucuucaccguguccugccgcgugcugacccggccgagccccgacuucgacuucaucuuccucgucccgcccaccguggagucccgcaccaagcccuucagcgugcccguccugacgguggaggagaugaccaacucccgguuccccaucccccuggagaagcuguucaccggcccgagcuccgccuucgucgugcagccccagaacgggcgcugcaccacggacggcgugcuccuggggaccacccagcucagccccgucaacaucugcaccuuccggggcgacgugacgcacaucaccggcuccagcaacuacaccaugaaccuggccucccagaacuggagcaacuacgacccgaccgaggagauccccgcgccccuggggacgcccgacuucgugggcaagauccaggggaugcucacccagaccacccgcacggacggcagcacccgggggcacaaggccaccgucuacaccggcuccgccgacuucgccccgaagcugggccgcgugcaguucgagacggacaccgaccacgacuucgaggccaaccagaacaccaaguucacccccgugggggucauccaggacggcagcacgacccaccggaacgagccccagcagugggugcugcccuccuacagcgggcgcaacaccccgaacgugcaccucgcccccgcggucgcccccaccuuccccggcgagcagcugcuguucuuccgguccacgaugccggggugcagcggcuaccccaacauggaccucgacugccugcugccccaggagugggugcaguacuucuaccaggaggccgcccccgcgcaguccgacguggcccuccugcgcuucgucaacccggacaccggccgggugcuguucgagugcaagcuccacaagagcggguacgugaccgucgcccacaccggccagcacgaccuggugaucccgcccaacggguacuuccgcuucgaggccugguga

SEQ ID NO: 12969 - RNA, 1563 nt, Artificial Sequence
  derived and/or modified sequence opt1 from VP1__Norovirus_and/or_Norovirus-like__KX764846
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaaggugaucuucgccgccgugccgcccaacuucccgacggaggggcugagccccucccaggucaccauguucccccacaucgugguggacguccggcagcuggagcccgugcucaucccgcugcccgacgugcgcaacaacuucuaccacuacaaccagagcaacgacccgcccaucaagcugaucgccaugcucuacacgccccugcgggcgaacaacgccggcgacgacgucuucaccguguccugccgcgugcugacccggcccagccccgacuucgacuucaucuuccucgugcccccgaccgucgagucccgcaccaagcccuucagcgugcccguccugaccguggaggagaugacgaacucccgguuccccaucccgcuggagaagcuguucaccggccccagcuccgccuucgucgugcagccccagaacgggcgcugcaccaccgacggcgugcuccuggggacgacccagcucagcccggucaacaucugcaccuuccggggcgacgugacccacaucacgggcucccgcaacuacaccaugaaccuggccagccagaacugguccaacuacgaccccaccgaggagauccccgcgccccuggggaccccggacuucgugggcaagauccaggggaugcucacgcagaccacccggaccgacggcagcacgcgcgggcacaaggccaccgucuacaccggcagcgccgacuucgcccccaagcugggccgggugcaguucgagaccgacacggaccacgacuucgaggccaaccagaacaccaaguucacccccgugggggucauccaggacggcuccaccacgcaccgcaacgagccccagcagugggugcugccgagcuacuccgggcggaacacccccaacgugcaccucgcccccgcggucgcccccaccuucccgggcgagcagcugcuguucuuccgcagcaccaugcccgggugcuccggcuaccccaacauggaccucgacugccugcugccccaggagugggugcaguacuucuaccaggaggccgccccggcgcagagcgacguggcccuccugcgguucgucaaccccgacacgggccgcgugcuguucgagugcaagcuccacaaguccggguacgugaccgucgcccacaccggccagcacgaccuggugaucccgcccaacggguacuuccgguucgacgccugguga

SEQ ID NO: 12970 - RNA, 1563 nt, Artificial Sequence
  derived and/or modified sequence opt1 from VP1__Norovirus_and/or_Norovirus-like__KX764833
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggggaccacccagcucagccccgugaacaucugcaccuuccggggcgacgugacgcacaucaccggcucccgcaacuacaccaugaaccuggccagccagaacuggaacaacuacgaccccaccgaggagaucccggcgccccuggggacgcccgacuucgucggcaagauccaggggaugcucacccagaccacccggacggacggcagcacccgcgggcaccgggccaccguguacaccggcuccgccgacuucgcccccaagcugggccgcgugcaguucgagacggacaccgaccacgacuucgaggccaaccagaacaccaaguucaccccggucggggugauccaggacggcagcacgacccaccggaacgagccccagcagugggugcugcccuccuacagcgggcgcaacacccacaacguccaccucgcccccgcgguggccccgaccuuccccggcgagcagcugcuguucuuccgguccacgaugcccgggugcagcggcuaccccaacauggaccucgacugccugcugccgcaggagugggugcaguacuucuaccaggaggccgcccccgcgcaguccgacgucgcccuccugcgcuucgugaaccccgacaccggccgggugcuguucgagugcaagcuccacaagagcggguacgucaccguggcccacaccggccagcacgaccuggugaucccgcccaacggguacuuccgcuucgacgccugguga

SEQ ID NO: 12971 - RNA, 1563 nt, Artificial Sequence
  derived and/or modified sequence opt1 from VP1__Norovirus_and/or_Norovirus-like__KX764834
augaagauggccagcuccgacgccaaccccagcgacggcuccgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaagaucaucuucgccgccgugccgcccaacuucccgacggaggggcugucccccagccaggugaccauguucccccacaucaucgucgacgugcggcagcuggagcccgugcucaucccgcugcccgacguccgcaacaacuucuaccacuacaaccaguccaacgacagcaccaucaagcugaucgccaugcucuacacgccccugcgggcgaacaacgccggcgacgacguguucaccguguccugccgcguccugacccggcccagcccggacuucgacuucaucuuccucgugccgcccaccguggagucccgcaccaagcccuucagcguccccgugcugacgguggaggagaugaccaacucccgguuccccaucccccuggagaagcuguucaccggccccagcuccgccuucgucgugcagccgcagaacgggcgcugcaccacggacggcguccuccuggacaccacccagcucagccccgugaacaucugcaccuuccgcggggacgugacgcacaucaccggcucccggaacuacaccaugaaccuggccagccagaacuggaacaacuacgaccccaccgaggagaucccggcgccccugggcacgcccgacuucgucgggaagauccagggcaugcucacccagaccacccggacggacgggagcacccgcggccacaaggccaccguguacaccggguccgccgacuucgcccccaagcugggccgggugcaguucgagacggacaccgaccacgacuucgaggccaaccagaacaccaaguucaccccggucggcgugauccaggacgggagcacgacccaccgcaacgagccccagcagugggugcugcccuccuacagcggccggaacacccacaacguccaccucgcccccgcgguggccccgaccuuccccggggagcagcugcuguucuuccgcuccacgaugcccggcugcagcggguaccccaacauggaccucgacugccugcugccgcaggagugggugcaguacuucuaccaggaggccgcccccgcgcaguccgacgucgcccuccugcgguucgugaaccccgacaccggccgcgugcuguucgagugcaagcuccacaagagcggcuacgucaccguggcccacaccgggcagcacgaccuggugaucccgcccaacggcuacuuccgguucgacuccugguga

SEQ ID NO: 12972 - RNA, 1563 nt, Artificial Sequence
  derived and/or modified sequence opt1 from VP1__Norovirus_and/or_Norovirus-like__KU687027
augaagauggccagcaacgacgccaaccccuccgacggcagcgcggccaaccuggugccggaggucaacaacgaggugauggcccucgagcccguggucggggccgccaucgcggcccugguggccggccagcagaacgugaucgaccccuggauccgcaacaacuucguccaggcccccgggggcgaguucaccguguccccgcggaacgcgcccggggagauccuguggagcgcgccccucggccccgaccugaacccguaccugucccaccucgcccgcauguacaacggcuacgccgggggcuucgaggugcaggucauccuggccgggaacgccuucaccgccggcaaggugaucuucgccgccgugccgcccaacuuccccacggaggggcugagccccucccaggucaccauguucccccacaucgugguggacguccggcagcucgagcccgugcugaucccccugccggacgugcgcaacaacuucuaccacuacaaccagagcaacgaccccaccaucaagcucaucgccaugcuguacacgccccugcgggcgaacaacgccggcgaggacgucuucaccguguccugccgcgugcucacccggcccagcccggacuucgacuucaucuuccuggucccgcccaccguggagucccgcaccaagcccuucagcgugcccguccugacgguggaggagaugaccaacucccgguuccccaucccccucgagaagcuguucaccggccccagcuccgccuucgucgugcagccgcagaacgggcgcugcaccacggacggcgugcugcucgggaccauccagcugagccccgucaacaucugcaccuuccggggcgacgugacccacaucacgggcucccgcaacuacaccaugaaccuggccagccagaacuggaacgacuacgaccccaccgaggagaucccggcgccccucgggacccccgacuucgugggcaagauccaggggaugcugacgcagaccacccggaccgacggcuccacgcgcgggcacaaggccaccgucuacaccggcagcgccgacuucgcccccaagcugggccgggugcaguucgagaccgacacggaccacgacuucgaggccaaccagaacaccaaguucaccccggugggggucauccaggacggcagcaccacgcaccgcaacgagccccagcagugggugcuccccuccuacagcgggcggaacacccccaacgugcaccuggccccggcggucgcccccaccuuccccggcgagcagcuccucuucuuccgcuccaccacgcccgggugcagcggcuacccgaacauggaccuggacugccugcucccccaggagugggugcaguacuucuaccaggaggccgcccccgcgcaguccgacguggcccugcugcgguucgucaaccccgacaccggccgcgugcuguucgagugcaagcugcacaagagcggguacgugaccgucgcccacaccggccagcacgaccuggugaucccgcccaacggguacuuccgguucgaguccugguga

SEQ ID NO: 12973 - RNA, 1563 nt, Artificial Sequence
  derived and/or modified sequence opt1 from VP1__Norovirus_and/or_Norovirus-like__KX764835
augaagauggccagcaacgacgccaaccccuccgacggcagcgcggccaaccuggugccggaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucauccucgccgggaacgccuucaccgccggcaagaucaucuucgccgccgugccgcccaacuucccgacggaggggcugagccccucccaggugaccauguucccccacaucaucgucgacgugcggcagcuggagcccgugcucaucccgcugcccgacguccgcaacaacuucuaccacuacaaccagagcaacgacuccaccaucaagcugaucgccaugcucuacaccccgccccgggcgaacaacgccggcgacgacguguucacggugagcugccgcguccugacccggcccucccccgacuucgacuucaucuuccuggugccgcccaccguggagagccgcaccaagcccuucuccguccccgugcucacgguggaggagaugaccaacagccgguuccccaucccccuggagaagcuguucaccggcccguccagcgccuucgucgugcagccccagaacgggcgcugcaccacggacggcguccuccuggggaccacccagcugucccccgugaacaucugcaccuuccggggcgacgugacgcacaucaccggcagccgcaacuacaccaugaaccucgccucccagaacuggaacaacuacgacccgaccgaggagauccccgcgccccuggggacgcccgacuucgucggcaagauccaggggaugcugacccagaccacccggacggacggcagcacccgcgggcacaaggccaccguguacaccggcagcgccgacuucgccccgaagcucggccgggugcaguucgagacggacaccgaccacgacuucgaggccaaccagaacaccaaguucacccccgucggggugauccaggacggcuccacgacccaccgcaacgagccccagcagugggugcugcccagcuacuccgggcggaacacccacaacguccaccuggccccggcgguggcccccaccuuccccggcgagcagcuccuguucuuccgcagcacgaugcccgggugcuccggcuacccgaacauggaccuggacugccuccugccccaggagugggugcaguacuucuaccaggaggccgcccccgcgcagagcgacgucgcccugcuccgguucgugaaccccgacaccggccgcgugcuguucgagugcaaguuccacaaguccggguacgucaccguggcccacaccggccagcacgaccuggugaucccgcccaacggguacuuccgguucgagagcugguga

SEQ ID NO: 12974 - RNA, 1563 nt, Artificial Sequence
  derived and/or modified sequence opt1 from VP1__Norovirus_and/or_Norovirus-like__KX764832
augaagauggccagcaacgacgugaaccccuccgacggcagcgccgcgaaccuggucccggaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugucccaccuggcccgcauguacaacggcuacgccgggggcuucgagguccaggugauccucgccgggaacgccuucaccgcgggcaagaucaucuucgccgccgugccgcccaacuucccgacggaggggcugagccccucccaggucaccauguucccccacaucaucguggacgugcggcagcuggagcccguccucaucccgcugcccgacgugcgcaacaacuucuaccacuacaaccagagcaacgacuccaccaucaagcugaucgccaugcucuacacgccccugcgggccaacaacgcgggcgacgacguguucaccgucagcugccgcgugcugacccggcccuccccggacuucgacuucaucuuccucgugccgcccaccgucgagagccgcaccaagcccuucuccgugcccgugcugacggucgaggagaugaccaacagccgguuccccaucccccuggagaagcuguucaccggccccuccagcgccuucgugguccagccgcagaacgggcgcugcaccacggacggcgugcuccuggggaccacccagcucucccccgugaacaucugcaccuuccggggcgacgucacgcacaucaccggcagccgcaacuacaccaugaaccuggccucccagaacuggaacaacuacgaccccaccgaggagaucccggcgccccuggggacgcccgacuucgugggcaagauccaggggaugcucacccagaccacccggacggacggcagcacccgcgggcacaaggccaccguguacaccggcagcgccgacuucgcccccaagcugggccggguccaguucgagacggacaccgaccacgacuucgaggccaaccagaacaccaaguucaccccggugggggugauccaggacggcuccacgacccaccgcaacgagccccagcagugggcccugcccagcuacuccgggcggaacacccacaacguccaccucgcccccgcgguggccccgaccuuccccggcgagcagcugcuguucuuccgcagcacgaugcccgggugcuccggcuaccccaacauggaccucgacugccugcugccgcaggagugggugcaguacuucuaccaggaggccgcccccgcgcagagcgacgucgcccuccugcgguucgugaaccccaacaccggccgcgugcuguucgagugcaagcuccacaaguccgggcacgucaccguggcccacaccggccagcacgaccuggugaucccgcccaacggguacuuccgguucgacagcugguga

SEQ ID NO: 12975 - RNA, 1563 nt, Artificial Sequence
  derived and/or modified sequence opt1 from VP1__Norovirus_and/or_Norovirus-like__KU687025
augaagauggccagcaacgacgccaaccccuccgacggcagcgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugucccaccuggcccgcauguacaacggcuacgccgggggcuucgaggugcaggucgugcucgccgggaacgccuucaccgccggcaaggugaucuucgccgccgucccgcccaacuucccgacggaggaccugagccccucccaggugaccauguucccccacaucguggucgacgugcggcagcuggagcccgugcucaucccgcugcccgacguccgcaacaacuucuaccacuacaaccagagcaacgaccccaccaucaagcugaucgccaugcucuacacgccccugcgggcgaacaacgccggggaggacguguucaccguguccugccgcguccugacccggccgagccccgacuucgacuucaucuuccucgugccgcccaccguggagucccgcaccaagcccuucagcguccccgugcugacggucgaggagaugaccaacucccgguuccccaucccccuggagaagcuguucaccggcccgagcuccgccuucguggugcagccccagaacggccgcugcaccacggacgggguccuccugggcaccauccagcucagccccgugaacaucugcaccuuccgcggggacgugacccacaucacgggcucccggaacuacaccaugaaccuggccagccagaacuggaacaacuacgacccgaccgaggagauccccgcgccccugggcacccccgacuucgucgggaagauccagggcaugcucacgcagaccacccggaccgacggguccacgcgcggccacaaggccaccguguacaccgggagcgccgacuucgccccgaagcugggccgggcccaguucgagaccgacacggaccacgacuucgaggccaaccagaacaccaaguucacccccgugggcgucauccaggacgggagcaccacgcaccgcaacgagccccagcagugggugcugcccuccuacagcggccggaacaccccgaacgugcaccucgcgcccgccgucgcccccaccuuccccggggagcagcugcuguucuuccgcuccaccacgccgggcugcagcggguaccccaacauggaccucgacugccugcugccccaggagugggugcaguacuucuaccaggaggccgcgcccgcccaguccgacguggcccuccugcgguucgucaacccggacaccggccgcgugcuguucgagugcaagcuccacaagagcggcuacgugaccgucgcccacgccgggcagcacgaccuggugaucccgcccaacggcuacuuccgguucgaggcgugguga

SEQ ID NO: 12976 - RNA, 1563 nt, Artificial Sequence
  derived and/or modified sequence opt1 from VP1__Norovirus_and/or_Norovirus-like__KU687026
augaagauggccagcuccgacgccaaccccagcgacggcuccgcggccaaccuggugcccgaggucaacaacgaggugauggcccucgagcccguggucggggccgccaucgcggcccccguggccggccagcagaacgugaucgaccccuggauccgcaacaacuucguccaggcccccgggggcgaguucaccgugagcccccggaacgcgcccggggagauccugugguccgcgccccugggcccggaccucaaccccuaccugagccaccuggcccgcauguacaacggcuacgccgggggcuucgaggugcaggucauccucgccgggaacgccuucaccgccggcaaggugaucuucgccgccgugccgcccaacuucccgacggaggggcugucccccagccaggucaccauguucccccacaucgugguggacguccggcagcuggagcccgugcucaucccgcugcccgacgugcgcaacaacuucuaccacuacaaccaguccaacgaccccaccaucaagcugaucgccaugcucuacacgccccugcgggcgaacaacgccggcgaggacgucuucaccgugagcugcaaggugcugacccgcccgucccccgacuucgacuucaucuuccucgucccgcccaccguggagagccggaccaagcccuucuccgugcccguccugacgguggaggagaugaccaacagccgcuuccccaucccccuggagaagcuguucaccggcccguccagcgccuucgucgugcagccccagaacgggcggugcaccacggacggcgugcuccuggggaccauccagcucucccccgucaacaucugcaccuuccgcggcgacgugacccacaucacgggcagccggaacuacaccaugaaccuggccucccagaacuggaacaacugcgacccgaccgaggagauccccgcgccccuggggacccccgacuucgugggcaagauccaggggaugcucacgcagaccacccgcaccgacggcagcacgcgggggcacaaggccaccgucuacaccggcagcgccgacuucgccccgaagcugggccgcgugcaguucgagaccgacacggaccacgacuucgaggccaaccagaacaccaaguucacccccgugggggucauccaggacggcuccaccacgcaccggaacgagccccagcagugggugcugcccagcuacuccgggcgcaacaccccgaacgugcaccucgcccccgcggucgcccccaccuuccccggcgagcagcugcuguucuuccggagcaccacgccggggugcuccggcuaccccaacauggaccucgacugccugcugccccaggagugggugcaguacuucuaccaggaggccgcccccgcgcagagcgacguggcccuccugcgcuucgucaacccggacaccggccgggugcuguucgagugcaagcuccacaaguccggguacgugaccgucgcccacaccggccagcacgaccuggugaucccgcccaacggguacuuccgcuucgacgccugguga

SEQ ID NO: 12977 - RNA, 1563 nt, Artificial Sequence
  derived and/or modified sequence opt1 from VP1__Norovirus_and/or_Norovirus-like__KU687028
augaagauggccagcaacgacgccaaccccuccgacggcagcgcggccaaccuggugcccgaggucaacaacgaggugauggcccucgagcccgccgugggggccgcgaucgccgcccccgucgccggccagcagaacgugaucgaccccuggauccgcaacaacuucgugcaggcgcccgggggcgaguucaccgucagcccccggaacgcccccggggagauccugugguccgcgccccugggcccggaccucaaccccuaccugucccaccuggcccgcauguacaacggcuacgccgggggcuucgagguccaggugauccucgccgggaacgccuucgccgccggcaaggugaucuucgccgcggugccgcccaacuucccgaccgaggggcugagccccucccaggugacgauguucccccacaucgucguggacgugcggcagcuggagcccguccucaucccgcugcccgacgugcgcaacaacuucuaccacuacaaccagagcaacgaccccaccaucaagcugaucgccaugcucuacacgccccugcgggccaacaacgccggcgaggacguguucaccgucuccugccgcgugcugacccggccgagccccgacuucgacuucaucuuccucgugccgcccaccgucgagucccgcaccaagcccuucagcgugcccgugcugaccgucgaggagaugacgaacucccgguuccccaucccccuggagaagcuguucaccggcccgagcuccgccuucgugguccagccccagaacgggcgcugcaccaccgacggcgugcuccuggggacgauccagcucagccccgugaacaucugcaccuuccggggcgacgucacccacaucaccggcucccgcaacuacacgaugaaccuggcgagccagaacuggaacaacuacgacccgaccgaggagauccccgcgccccuggggacccccgacuucgugggcaagauccaggggaugcucacccagacgacccggaccgacggcuccacccgcgggcacaaggccacgguguacaccggcagcgccgacuucgccccgaagcugggccggguccaguucgagaccgacaccgaccacgacuucgaggccaaccagaacacgaaguucacccccgugggggugauccaggacggcagcaccacccaccgcaacgagccccagcaguggguccugcccuccuacagcgggcggaacacgccgaacgugcaccucgcccccgccgugccgcccaccuuccccggcgagcagcugcuguucuuccgcuccaccacccccgggugcagcggcuaccccaacauggaccucgacugccugcugccccaggaguggguccaguacuucuaccaggaggccgcgccggcccaguccgacguggcccuccugcgguucgugaaccccgacacgggccgcguccuguucgagugcaagcuccacaagagcggguacgugaccguggcccacaccggccagcacgaccuggucaucccgcccaacggguacuuccgguucgaguccugguga

SEQ ID NO: 12978 - RNA, 1563 nt, Artificial Sequence
  derived and/or modified sequence opt1 from VP1__Norovirus_and/or_Norovirus-like__KX764831
augaagauggccagcuccgacgugaaccccagcgacggcuccgccgcgaaccuggucccggaggugaacaacgaggugauggcccucgagcccgucgugggggccgccaucgccgcgcccguggccggccagcagaacgucaucgaccccuggauccgcaacaacuucgugcaggcccccgggggcgaguucaccgugagcccccggaacgcccccggggagauccugugguccgcgccccugggcccggaccucaaccccuaccugagccaccuggcccgcauguacaacggcuacgccgggggcuucgagguccaggugauccucgccgggaacgccuucaccgcgggcaagaucaucuucgccgccgugccgcccaacuucccgaccgggggccugucccccagccaggucaccauguucccccacaucaucguggacgugcggcagcuggagcccguccucaucccgcugcccgacgugcgcaacaacuucuaccacuacaaccaguccaacgacagcaccaucaagcugaucgccaugcucuacacgccccugcgggccaacaacgcgggcgacgacguguucacggucuccugccgcgugcugacccggcccagcccggacuucgacuucaucuuccucgugccgcccaccgucgagucccgcaccaagcccuucagcgugcccgugcugacggucgaggagaugaccaacucccgguuccccaucccccuggagaagcuguucaccgggcccagcuccgccuucgugguccagccgcagaacggccgcugcaccacggacggggugcuccugggcaccacccagcucagccccgugaacaucugcaccuuccggggcgacgucacgcacaucaccgggucccgcaacuacaccaugaaccuggccagccagaacuggaacaacuacgaccccaccgaggagaucccggcgccccugggcacgcccgacuucguggggaagauccagggcaugcucacccagaccacccggacggacgggcccacccgcggccacaaggccaccguguacaccggcagcgccgacuucgccccgaagcuggggcggguccaguucgagacggacaccgaccacgacuucgaggccaaccagaacaccaaguucacccccgugggcgugauccaggacggguccacgacccaccgcaacgagccccagcaguggguccugcccagcuacuccggccggaacacccacaacgugcaccucgccccggccguggcgcccaccuuccccggggagcagcugcuguucuuccgcagcacgaugcccggcugcuccggcuacccgaacauggaccucgacugccugcugccccaggaguggguccaguacuucuaccaggaggccgcccccgcccagagcgacguggcgcuccugcgguucgugaaccccgacaccgggcgcguccuguucgagugcaagcuccacaaguccggcuacgugaccguggcccacaccgggcagcacgaccuggucaucccgcccaacggcuacuuccgguucgaggccugguga

SEQ ID NO: 12979 - RNA, 1560 nt, Artificial Sequence
  derived and/or modified sequence opt1 from VP1__Norovirus_and/or_Norovirus-like__JN222366
augaugauggccagcaaggacgcccccaccuccccggacggcgcgagcggggccggccagcuggugcccgaggccaacaccgccgagcagaucuccauggaccccgucgccggggcgagcacggccguggccaccgccggccaggugaacaugaucgaccccuggaucuucaacaacuucguccaggcgccgcagggggaguucaccaucucccccaacaacacccccggcgacauccucuucgaccugcagcugggcccccaccucaacccguuccuggcccaccugagccagauguacaacgggugggugggcaacaugcgcgugcggauccuccuggccgggaacgccuucacggccggcaagaucaucaucugcugcgucccgcccggguucgacgcgcgcauccugaccaucgcccaggccacccucuucccccaccugaucgccgacgugcggacccuggagcccguggagcucccccuggaggacguccgcaacgugcuguaccacaacuccagccagccccagcccacgaugcggcucguggccaugcuguacaccccgcugcgcaccggcggcggguccggcgggaccgacgcguucgucguggccggccgggugcucacgugccccgcccccgacuucagcuuccuguuccuggugcccccguccgucgagcagaagacccgcguguucagcguccccaacaucccccucaaggaccuguccaacagccgggugcccgugccgauccagggcauguucaugucccccgacgucaaccagagcgugcaguuccagaacgggcgcugccagaucgacggccagcugcaggggaccacccccgugucccucagccagcugugcaagauccggggcaagacguccagcaacgcccgcguccugaaccucagcgagguggacgggacccccuucaucccgcuggagucccccgcccccgucggcuucccggaccugggcgggugcgacuggcacgugaacuucaccuuccaggcgcagaaccaggaccccagccaguccgugaccuucgccacgaacgacgccagcuucguccccuaccucggcuccaucagcccccacaacgggggcgacuuccacgccggggacaucaucggcucccugggcuggaucagcgccccguccgacaacagccagcugaacguguggaccauccccaaguacggguccagccuccccgacgugacccaccuggcgcccgccgucuucccgcccggcuucggggaggugauccuguacuucuacuccaccuuccccggcagcgggcagcccucccagcuccaggugccgugccugcugccccaggaguucaucacgcacuucugcaacgagcaggcccccaucgccggcgaggcggcccuccugcacuacgucgaccccgacaccggccggaaccugggggaguucaagcucuacccggacggcuucaugaccugcgugcccaacagcguguccagcgggccccagacccugcccaucaacggcgucuucguguucguguccugggucagccgcuga

SEQ ID NO: 12980 - RNA, 1557 nt, Artificial Sequence
  derived and/or modified sequence opt1 from VP1__Norovirus_and/or_Norovirus-like__KM386679
augaagauggccagcaacgacgccacccccuccaacgacggcgcggccgggcuggugccggagagcaacaacgaggccauggcccucgagcccgucgugggcgccucccuggcggcccccgugaccgggcagacgaacaucaucgaccccuggauccgcaccaacuucguccaggccccgaacggcgaguucaccgugagcccccggaacucccccggggagauccuggugaaccucgagcugggccccgagcugaacccguaccucgcccaccuggcgcgcauguacaacggcuacgccgggggcauggagguccaggugaugcuggccgggaacgccuucaccgccggcaagaucaucuucgcggccgugccgcccuacuuccccgucgagaaccucagccccucccagaucacgauguucccccacgugaucaucgacgugcggacccuggagcccguccugcuccccaugccggacgugcgcagcacccuguuccacuucaaccagaaggacgagcccaagaugcggcugguggccaugcucuacacgccccugcgcuccaacgggagcggcgacgacgucuucaccguguccugccggauccugacccgccccagcccggaguucgacuucaccuaccucgugccgcccaccgucgaguccaagacgaagcccuucacccugcccgugcugacccucggcgagcugagcaacucccgguucccccugagcaucgacgagauggugaccucccccaacgagagcaucgucgugcagccccagaacgggcgcgugacgcucgacggcgagcugcuggggaccacccagcuccaggccugcaacaucugcuccauccggggcaaggucaccggccaggugccgaacgagcagcacauguggaaccuggagaucacgaaccugaacgggacccaguucgaccccaccgacgacguccccgccccgcucggcgugcccgacuucgcgggggagguguucggcguccugagccagcgcaaccgcggggagagcaaccccgccaaccgggcccacgacgccgugguggccaccuacuccgacaaguacacgcccaagcugggccucguccagaucggcaccuggaacaccaacgacguggagaaccagccgaccaaguucacgcccaucgggcugaacgagguggcgaacggccaccgguucgagcaguggacccugccccgcuacagcggggcccucacccugaacaugaaccuggcccccgccgucgccccgcuguuccccggcgagcggcuccuguucuuccgcuccuacgugccccucaagggcggguucggcaaccccgcgaucgacugccuggugccgcaggaguggguccagcacuucuaccaggagagcgcccccucccugggggacguggcccucgugcgguacgucaaccccgacaccggccgcgugcuguucgaggccaagcugcacaagggcggguuccucacggugagcuccaccagcaccgggcccgucguggugccggcgaacggcuacuuccgguucgacuga

SEQ ID NO: 12981 - RNA, 1551 nt, Artificial Sequence
  derived and/or modified sequence opt1 from VP1__Norovirus_and/or_Norovirus-like__AY549156
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacacguccuaccucacccccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagccgcccuucacccuccccaaccugcccgugaacaaccugucccacagccgcgugauggagcccaucgcccagaugauguccagccggaacuuccccgccuccguccaguuccagaacgggcgcugcacgcucagcggcgaccugcuggggaccacccccuccagccccgccgaccucggcgcguucgugggccugcgggccgagccggggucccgcgucguggagcugagccagcccaaccaggaggacuuccacgccggcagcgcccccgcccccuucggguucccggacuucuccgacugcagcgugaccuucgucguggcguccgccacgaccgugggcgagcggaccgucaacacccgcagccuccagaacuucacgcccgcccuggggcacaucaccuucgacgaggaggcccccgccgaccuguuccgggcgcacuuccgcaaccucugggagcccaccgagcacuccuucuggcggaucccggacuaccgcgccgacgugcugggcagcgacuucgcccccuccgugagcgcccccggcgucggggagacccuccuguucuucaugugcaacgugccccgccugaacggcgcgaacccgaaccccugccccugccugcucccccaggaguggaucacgcacuucguguccgagcgggccgcccugcagagcgacgucgcccugcucaacuacgugaacccgaacaccgggcgcgugcuguucgaggccaagcuguacgcgaacggcuuccucaccgucaaccugggggcccccgaccaggccacccugcccguggacggcaucuucaaguucguguccugggucagcuccuacuaccagcuccggcccgugggcaacgccagcgccgggcgccggcuguga

SEQ ID NO: 12982 - RNA, 1551 nt, Artificial Sequence
  derived and/or modified sequence opt1 from VP1__Norovirus_and/or_Norovirus-like__AY549163
augaagaugaccgaccgcgacaccaucgacagcgcccccgcccugggccaggugcucccgcccgaggucgaggcguccgugcccguggagcccacggccggggccccggucgccgcccccaccgcgggccaggugaaccccaucgaccccuggaucuucgccaacuucgugcaggccccgcagggggaguucaccaucagccccaacaacaaccccggcgagauccuguucgagcuggagcucgggcccgaccugaacccguaccuggcccaccuccggcgcauguacaacggcuggaccggcuccaugcggguccgcgugcugcuggcggggaacgccuucagcgccggcaagguggucguguucugcgugccgcccggguucgacacguccuaccucacccccagccaggccacccaguucccccacguccugaucgacgugcgggcccccgagcccguggagaugccccuggaggacguccgcaacauccucuuccaccagggcccggacucccggaugcgccugauggggaugcuguacacgccccuccgggcgaacuacggcgccgaccccuucguggugaccggccgcguccugaccugccccagcccgaacuucuccuucuucuuccuggugccgcccaccguggaggagcgggagacccccuucacgcuccccaaccugcccgucaacaaccugagccacucccgcgugauggagcccaucgcccagaugaugagcucccggaacuucccggccagcgugcaguuccagaacgggcgcugcacccucuccggcgaccugcuggggaccacccccagcucccccgccgaccucggcgcguucgucggccugcgggccgagcccgggagccgcguggucgagcugucccagccgaaccaggaggacuuccacgccggcagcgcccccgcccccuucggguuccccgacuucagcgacugcuccgugacguucguggucgcgagcgccaccaccgugggcgagcggaccgugaacacgcgcucccuccagaacuucaccccggcccuggggcacaucaccuucgacgaggaggcccccgccgaccuguuccgggcgcacuuccgcaaccucugggagcccaccgagcacagcuucuggcggauccccgacuaccgcgccgacguccugggcuccgacuucgccccgagcguguccgcccccggcgugggggagacgcuccuguucuucaugugcaacgucccccgccugaacggcgcgaaccccaacccgugccccugccugcucccccaggaguggaucacccacuucgugagcgagcgggccgcccugcaguccgacguggcccugcucaacuacgucaaccccaacaccgggcgcgugcuguucgaggccaagcuguacgcgaacggcuuccucaccgugaaccugggggccagcgaccaggccauccugccggucgacggcaucuucaaguucguguccugggugagcuucuacuaccagcuccggcccgucggcaacgccuccguggggcgccggcuguga

SEQ ID NO: 12983 - RNA, 1551 nt, Artificial Sequence
  derived and/or modified sequence opt1 from VP1__Norovirus_and/or_Norovirus-like__AY549159
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacacguccuaccucacccccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagacccccuucacgcuccccaaccugcccgugaacaaccugucccacagccgcgugauggagcccaucgcccagaugauguccagccggaacuucccggccuccguccaguuccagaacgggcgcugcacccucagcggcgaccugcuggggaccacccccuccagccccgccgaccucggcgcguucgugggccugcgggccgagcccgggucccgcgucguggagcugagccagccgaaccaggaggacuuccacgccggcagcgcccccgcccccuucggguuccccgacuucuccgacugcagcgugacguucgucguggcguccgccaccaccgugggcgagcggaccgucaacgcccgcagccuccagaacuucacgccggcccuggggcacaucaccuucgacgaggaggcccccgcggaccuguuccgggcccaccuccgcaaccugugggagcccaccgagcacuccuucuggcggauccccgacuaccgcgccgacgugcugggcagcgacuucgccccguccgugagcgcgcccggcgucggggagacccuccuguucuucaugugcaacgugccccgccugaacggcgccaaccccaacccgugccccugccuccugccccaggaguggaucacgcacuucguguccgagcgggccgcccugcagagcgacgucgcccuccugaacuacgugucccccaacaccgggcgcgugcuguucgaggcgaagcucuacgccaacggcuuccugaccgucaaccugggggccagcgaccaggccacccucccgguggacggcaucuucaaguucguguccugggucagcuucuacuaccagcugcggcccgugggcaacgccuccguggggcgccggcuguga

SEQ ID NO: 12984 - RNA, 1551 nt, Artificial Sequence
  derived and/or modified sequence opt1 from VP1__Norovirus_and/or_Norovirus-like__AY549166
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacacguccuaccucacccccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagacccccuucacgcuccccaaccugcccgugaacaaccugucccacagccgcgugauggagcccaucgcccagaugauguccagccggaacuucccggccuccguccaguuccagaacgggcgcugcacccucagcggcgaccugcuggggaccacccccuccagccccgccgaccucggcgcguucgugggccugcgggccgagcccgggucccgcgucguggagcugagccagccgaaccaggaggacuuccacgccggcagcgcccccgcccccuucggguuccccgacuucuccgacugcagcgugacguucgucguggcguccgccaccaccgugggcgagcggaccgucaacacgcgcagccuccagaacuucaccccggcccuggggcacaucaccuucgacgaggaggcccccgccgaccuguuccgggcgcacuuccgcaaccucugggagcccaccgagcacuccuucuggcggauccccgacuaccgcgccgacgugcugggcagcgacuucgccccguccgugagcgcccccggcgucggggagacgcuccuguucuucaugugcaacgugccccgccugaacggcgcgaaccccaacccgugccccugccugcucccccaggaguggaucacccacuucguguccgagcgggccgcccugcagagcgacgucgcccugcucaacuacgugaaccccaacaccgggcgcgugcugcuggaggccaagcucugcgcgaacggcuuccugaccgucaaccugggggccuccgaccaggccacgcucccgguggacggcaucuucaaguucgugagcugggucuccuucuacuaccagcugcggcccgugggcaacgccagcguggggcgccggcuguga

SEQ ID NO: 12985 - RNA, 1551 nt, Artificial Sequence
  derived and/or modified sequence opt1 from VP1__Norovirus_and/or_Norovirus-like__AF320113
augaagaugaccgaccgcgacaucaucgacagcgcccccgcccugggccaggugcucccgcccgaggucgaggcguccgugcccguggagcccaccgccggggccccggucgccgcccccacggcgggccaggugaaccccaucgaccccuggaucuucgccaacuucgugcaggccccgcagggggaguucaccaucagccccaacaacaaccccggcgagauccuguucgagcuggagcucgggcccgaccugaacccguaccuggcccaccuccggcgcauguacaacggcuggaccggcuccaugcggguccgcgugcugcuggcggggaacgccuucagcgccggcaagguggucguguucugcgugccgcccggguucgacaccuccuaccucacgcccagccaggccacccaguucccccacguccugaucgacgugcgggcccccgagcccguggagaugccccuggaggacguccgcaacauccucuuccaccagggcccggacucccggaugcgccugauggggaugcuguacacgccccuccgggcgaacagcggcgccgaccccuucguggugaccggccgcguccugcccugcccgucccccaacuucagcuucuucuuccuggugccgcccaccguggaggagcgggagccgcccuucacccuccccaaccugcccgucaacaaccugucccacagccgcgugauggagcccaucgcccagaugauguccagccggaccuuccccgccuccgugcaguuccagaacgggcgcugcacccucagcggcgaccugcuggggacgacccccuccagcccguccgaccucggcgccuucgucggccugaucgcggagcccgggagccggguggucgagcuguuccagcccaaccaggaggacuuccacgccggcagcgcccccgccccgcucggguuccccgacuucuccgacugcagccugaccuucgugguggccuccgcgaccacggucggcgagcgcaccgugaacgcccggagccugcagaacuucacccccgcccucgggcacaucaccuucgacgaggaggcccccgccgaccuguuccgcgcgcaccuccggaaccugugggacccgacggagcacuccuucuggcgcauccccgacuaccgggccgacgugcugggcagcgagcuggcccccuccgucagcgcccccggcgugggggagacccuccuguucuucacgugcaacgugccgcgccugaacggcgcgaaccccaaccccugccccugccuccugccgcaggaguggaucacccacuucgucuccgagcgcgccgcccugcagagcgacguggcccuccugaacuacgugaaccccaacaccgggcggguccuguucgaggccaagcucuacgugaacggcuuccugaccgugaaccugggggcguccgaccaggccacccuccccgucgacggcaucuucaaguucgugagcuggguguccuucuacuaccagcugcgccccgucggcaacgccagcguggggcggcgccuguga

SEQ ID NO: 12986 - RNA, 1551 nt, Artificial Sequence
  derived and/or modified sequence opt1 from VP1__Norovirus_and/or_Norovirus-like__AY549153
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacacguccuaccucacccccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagccgcccuucacccuccccaaccugcccgugaacaaccugucccacagccgcgugauggagcccaucgcccagaugauguccagccgguccagccccgccuccauccaguuccagaacgggcgcugcacgcucagcggcgaccugcuggggaccacccccuccagccccgccgaccucggcgcguucgucggccugcgggccgagccggggagccacguggucgagcugucccagcccaaccaggaggacuuccacgccggcagcgcccccgcccccuucggguucccggacuucuccgacugcagcgugaccuucguggucgcguccgccacgaucguggagcagcgcaccgugaacgcccggagccuccagaacuucacccccgcccugggccacaucaccuucgacgaggaggcccccgcggaccuguuccgcgcccgguuccgcaacgucugggaccccacggagcacuccuucuggcggaucccggacuaccgcgccgacgugcucgggagcgacuucgcccccuccgugagcgcgcccggcgucggcgagacccugcuguucuucaugugcaacgugccccacuccaacggggccaacccgaaccccugccccugccuccugccccaggaguggaucacccacuucgugagcgagcgcgccgcccugcagggcgacgucgcccuccugaacuacaucaacccgaacaccgggcggguguccuucgaggcgaagcuguacgccaacggcuuccucacggugaaccugggggccagcgaccgcaccacccugcccgucgacggcaucuucaaguucguguccugggugagcuucuacuaccagcuccggcccgucggcaacgccuccguggggcgccggcuguga

SEQ ID NO: 12987 - RNA, 1551 nt, Artificial Sequence
  derived and/or modified sequence opt1 from VP1__Norovirus_and/or_Norovirus-like__AY549157
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacacguccuaccucacccccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagccgcccuucacccuccccaaccugcccgugaacaaccugucccacagccgcgugauggagcccaucgcccagaugauguccagccggaacuuccccgccuccguccaguuccagaacgggcgccggacgcucagcggcgaccugcuggggaccacccccuccagccccgccgaccucggcgcguucgugggccugcgcgccgagccggggucccgggucguggagcugagccagcccaaccaggaggacuuccacgccggcagcgcccccgcccccuucggguucccggacuucuccgacugcagcgugaccuucgucguggcguccgccacgaccgugggcgagcgcaccgucaacacccggagccuccagaacuucacgcccgcccuggggcacaucaccuucgacgaggaggcccccgccgaccuguuccgcgcgcacuuccggaaccucugggagcccaccgagcacuccuucuggcgcaucccggacuaccgcgccgacgugcugggcagcgacuucgcccccuccgugagcgcccccggcgucggggagacccuccuguucuucaugugcaacgugccccggcugaacggcgcgaacccgaaccccugccccugccugcucccccaggaguggaucacgcacuucguguccgagcgcgccgcccugcagagcgacgucgcccugcucaacuacgugaacccgaacaccgggcgggugcuguucgaggccaagcuguacgcgaacggcuuccucaccgucaaccugggggccuccgaccaggccacccugcccguggacggcaucuucaaguucgugagcugggucuccuucuacuaccagcuccgccccgugggcaacgccagcguggggcggcgccuguga

SEQ ID NO: 12988 - RNA, 1551 nt, Artificial Sequence
  derived and/or modified sequence opt1 from VP1__Norovirus_and/or_Norovirus-like__AY549158
augaagaugaccgaccgcgacgccguggacagcgcccccgcgcugggccagguccucccgcccgagguggaggccuccgugcccgucgagcccaccgccggggccccgguggccgcgcccacggccggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcgcaccuccggcgcauguacaacggcuggaccggcuccaugcgggugcgcgugcugcuggccgggaacgccuucagcgccggcaaggucgugguguucugcgucccgcccggguucgacaccuccuaccucacgcccagccaggccacccaguucccccacgugcugaucgacgugcgggcgcccgagcccgucgagaugccccuggaggacgugcgcaacauccucuuccaccagggcccggacucccggaugcgccugauggggaugcuguacacgccccuccgggccaacagcggcgccgaccccuucguggucaccggccgcgugcugaccugccccuccccgaacuucagcuucuucuuccuggugccgcccaccgucgaggagcgggagccgcccuucacccuccccaaccugcccgugaacaaccccucccacagccgcgugauggagcccaucgcccagaugauguccagccggaacuuccccgccuccguccaguuccagaacgggcgcugcacccugagcggcgaccuccuggggacgacccccuccagcccggcggaccugggcgccuucgugggccuccgggccgagcccgggucccgcgucguggagcugagccagcccaaccaggaggacuuccacgccggcagcgcccccgcgccguucggguuccccgacuucuccgacugcagcgugaccuucgucguggccuccgccaccacggugggcgagcggaccgucaacacccgcagccugcagaacuucacccccgcccucgggcacaucacguucgacgaggaggcccccgcggaccuguuccgggcccacuuccgcaaccugugggagccgaccgagcacuccuucuggcggauccccgacuaccgcgccgacgugcucggcagcgacuucgcccccuccgugagcgcgcccggcgucggggagacccugcuguucuucaugugcaacgugccgcgccucaacggcgccaaccccaaccccugccccugccugcugccgcaggaguggaucacccacuucguguccgagcgggccgcccuccagagcgacgucgcccugcugaacuacgugaaccccaacacggggcgcguccucuucgaggcgaagcuguacgccaacggcucccugaccgugaaccucggggccagcgaccaggccacccugcccguggacggcaucuucaaguucguguccugggucagcuucuacuaccagcugcggcccgugggcaacgccuccguggggcgccggcucuga

SEQ ID NO: 12989 - RNA, 1551 nt, Artificial Sequence
  derived and/or modified sequence opt1 from VP1__Norovirus_and/or_Norovirus-like__AY549165
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacgccuccuaccucacgcccagccaggccacccaguucccccacgugcugaucgacgugcgggcgcccgagcccgucgagaugccccuggaggacgugcgcaacauccucuuccaccagggcccggacucccggaugcgccugauggggaugcuguacacgccccuccgggccaacagcggcgccgaccccuucguggucaccggccgcgugcugaccugccccuccccgaacuucagcuucuucuuccuggggccgcccaccguggaggagcgggagccccucuucacccugcccaaccugcccgucaacaaccucucccacagccgcgugauggagcccaucgcccagaugauguccagccgguccuucccggccagcgugcaguuccagaacggccgcugcacccuguccggggaccugcucggcacgacccccagcucccccgcggaccugggcgccuucgucgggcugcgggccgagcccggcagccacguggucgagcucagccagccgaaccaggaggacuuccacgccggguccgcccccgcgcccuucggcuuccccgacuucagcgggugcuccgugaccuucguggucgccagcgccaccaucguggagcagcgcacggugaacacccggucccugcagaacuucaccccggcccugggccacaucaccuucgacgaggaggcccccgcggaccucuuccgcgcccgguuccgcaacgucugggaccccacggagcacagcuucuggcggauccccgacuaccgcgccgacgugcugggcuccgacuucgccccgagcguguccgcgcccgggggcggggagacccuccuguucuucaugugcaacgucccccacagcaacggcgccaaccccaacccgugccccugccugcugccccaggaguggaucacccacuucguguccgagcgcgccgcccuccagggggacguggcccugcugaacuacaucaaccccaacaccggccggguccucuucgaggcgaagcuguacgccaacggcuuccugacggugaaccucggggccagcgaccaggccgcccugccgguggacggcaucuucaaguucgucuccugggugagcuucuacuaccagcugcgccccguggggaacgcguccgucggccggcgccucuga

SEQ ID NO: 12990 - RNA, 1551 nt, Artificial Sequence
  derived and/or modified sequence opt1 from VP1__Norovirus_and/or_Norovirus-like__AY549167
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacacguccuaccucacccccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagccccucuucacccugcccaaccugcccgugaacaaccucucccacagccgcgugauggagcccaucgcccagaugauguccagccggggguucccggccuccguccaguuccagaacggccgcugcacgcugagcggggaccugcucggcaccacccccuccagccccgccgaccugggcgcguucguggggcugcgggccgagcccggcucccacgucguggagcucagccagccgaaccaggaggacuuccacgccgggagcgcccccgcccccuucggcuuccccgacuucuccgacugcagcgugaccuucgucguggcguccgccacgaucguggagcagcgcaccgucaacgcccggagccugcagaacuucaccccggcccuggggcacaucaccuucgacgaggaggcccccgcggaccucuuccgcgcccgguuccgcaacgugugggaccccacggagcacuccuucuggcggauccccgacuaccgcgccgacgugcugggcagcgacuucgccccguccgucagcgcgcccggcgugggggagacccuccucuucuucaugugcaacgugccccacuccagcggcgccaaccccaacccgugccccugccugcugccccaggaguggaucacccacuucgucuccgagcgcgccgcccuccagggggacguggcccugcugaacuacaucaaccccaacaccggccgggugcuguucgaggcgaagcuguacgccaacggguuccugacggucaaccucggcgccagcgaccaggccacccugccgguggacggcaucuucaaguucguguccugggucagcuucuacuaccagcugcgccccguggggaacgccuccgugggccggcgccucuga

SEQ ID NO: 12991 - RNA, 1551 nt, Artificial Sequence
  derived and/or modified sequence opt1 from VP1__Norovirus_and/or_Norovirus-like__AY549154
augaagaugaccgaccgcgacaccguggaccccgccccggcccugggccagguccucccgcccgagguggaggcgagcgugcccgucgagcccacggccggggcccccguggccgcccccaccgcgggccaggugaaccccaucgacccguggaucuucgccaacuucguccaggcgccccagggggaguucaccaucucccccaacaacaaccccggcgagauccuguucgagcuggagcucgggccggaccugaaccccuaccuggcccaccuccggcacauguacaacggcuggaccggcagcaugcgcgugcgggugcugcuggccgggaacgccuucuccgccggcaaggucgugguguucugcgucccgcccggguucgacacgagcuaccucacccccucccaggccacccaguucccccacgugcugaucgacgugcgcgcccccgagcccgucgagaugccgcuggaggacgugcggaacauccucuuccaccagggccccgacagccgcaugcggcugauggggaugcuguacacgccccuccgcgcgaacuccagcgccgaccccuucguggucaccggccgggugcugaccugcccgaaccccaacuucuccuucuucuuccuggugccgcccaccgucgaggagcgcgagccgcccuucacccuccccaaccugcccgugaacaaccugagccacucccgggugauggagcccaucgcccagaugaugagcucccgcaacuuccccgccagcguccaguuccagaacggccggugcacgcucuccggggaccugcugggcaccacccccagcuccccggccgaccucggggcguucgugggccugcgcgccgagcccggcagccgggucguggagcugucccagcccaaccaggaggacuuccacgccgggagcgcccccgccccguucggcuuccccgacuucagcgacugcuccgugaccuucgucguggcgagcgccacgaccgugggggagcgcaccgucaacacccggucccuccagaacuucacgcccgcccugggccacaucaccuucgacgaggaggcccccgccgaccuguuccgcgcgcacuuccggaaccucugggagccgaccgagcacagcuucuggcgcauccccgacuaccgggccgacgugcugggguccgacuucgcccccagcguguccgcccccggcgucggcgagacccuccuguucuucaugugcaacgugccgcgccugaacggggcgaaccccaaccccugccccugccugcucccgcaggaguggaucacgcacuucgugagcgagcgcgccgcccugcaguccgacgucgcccugcucaacuacgugaaccccaacaccggccgggugcuguucgaggccaagcuguacgcgaacggguuccucaccgucaaccugggcgccagcgaccaggccacccugcccguggacgggaucuucaaguucguguccugggucagcuucuacuaccagcuccgccccgugggcaacgccuccgugggccggcgccuguga

SEQ ID NO: 12992 - RNA, 1551 nt, Artificial Sequence
  derived and/or modified sequence opt1 from VP1__Norovirus_and/or_Norovirus-like__AY549155
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcguguacaacggcuggaccggcuccaugcgggugcgcguccugcuggcggggaacgccuucagcgccggcaaggugguggucuucugcgugccgcccggguucgacacguccuaccucacccccagccaggccacccaguucccccacgugcugaucgacguccgggcccccgagcccguggagaugccccuggaggacgugcgcaacauccucuuccaccagggcccggacucccggaugaagcugauggggaugcuguacacgccccuccgcgcgaacagcuccgccaaccccuucgucgugaccggccgggugcugaccugccccagcccgaacuucuccuucuucuuccuggucccgcccaccguggaggagcgcgagccgcccuucacccuccccaaccugcccgugaacaaccugagccacucccaggucauggagcccaucgcccagaugaugagcucccggaacuuccccgccagcgugcaguuccagaacggccgcugcacgcucuccggggaccugcugggcaccacccccagcucccccgccgaccucggggcguucgucggccugcgggccgagccgggcagccgcgugguggagcugagccagcccaaccaggaggacuuccacgccggguccgcccccgcccccuucggcuucccggacuucagcgacugcuccgucaccuucgugguggcgagcgccacgaccgucggggagcggaccgugaacgcccgcacccuccagaacuucacgcccgcccugggccacaucaccuucgacgaggaggcccccgcggaccuguuccgggcccacuuccgcaaccucugggagcccaccgagcacuccuucuggcggaucccggacuaccgcgccgacgugcuggggagcgacuucgcccccuccgucagcgcgcccggcgugggcgagacccuccuguucuucaugugcaacgugccccggcugaacggggccaacccgaaccccugccccugccugcucccccaggaguggaucacgcacuucgucuccgagcgcgccgcccugcagagcgacguggcccugcucaacuacgugaacccgaacaccggccgcguccuguucgaggcgaagcuguacgccaacggguuccucaccgugaaccugggcgccuccgaccaggccacccugcccguggacgggaucuucaaguucgucagcuggguguccuucuacuaccagcuccggcccgugggcaacgccagcgucggccgccggcuguga

SEQ ID NO: 12993 - RNA, 1551 nt, Artificial Sequence
  derived and/or modified sequence opt1 from VP1__Norovirus_and/or_Norovirus-like__AF320625
augaagaugaccgaccgcgacaucaucgacagcgcccccgcccugggccaggugcucccgcccgaggucgaggcguccgugcccguggagcccaccgccggggccccggucgccgcccccacggcgggccaggugaaccccaucgaccccuggaucuucgccaacuucgugcaggccccgcagggggucuucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacaccuccuaccucacgcccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagcccuccuucacccuccccaaccugcccgugaacaaccugagccacucccgcgugauggagcccaucgcccagaugaugagcucccggaccuucccggccagcguccaguuccagaacgggcgcugcacgcucuccggcgaccugcuggggaccacccccagcucccccagcgaccucggcgccuucgugggccugaucgcggagcccgggagccggaucgucgagcugucccagccgaaccaggaggacuuccacgccggcagcgcccccgcccccuucggguuccccgacuucuccgacugcagccucaccuucgugguggccuccgcgacgaccgucggcgagcgcaccgugaacgcccggagccugcagaacuucaccccggcccuggggcacaucacguucgacgaggaggcccccgccgaccucuuccgcgcgcaccuccggaaccugugggaccccaccgagcacuccuucuggcgcauccccgacuaccgggccgacgugcugggcagcgaguucgccccguccgucagcgcccccggcgugggggagacccugcuguucuucaugugcaacgugccccgccucaacggcgcgaaccccaacccgugccccugccugcugccccaggaguggaucacccacuucgucuccgagcgcgccgcccuccagagcgacguggcccugcugaacuacgugaaccccaacacggggcggguccucuucgaggccaagcuguacgcgaacggcuuccugaccgugaaccucggggccuccgaccaggccacccugccgguggacggcaucuucaaguucgucagcuggguguccuucuacuaccagcugcgccccgugggcaacgccagcgucgggcggcgccucuga

SEQ ID NO: 12994 - RNA, 1551 nt, Artificial Sequence
  derived and/or modified sequence opt1 from VP1__Norovirus_and/or_Norovirus-like__AY274820
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcacggggaguucaccaucagccccaacaacaaccccggcgaggugcuguucgagcugaagcucgggcccgaccugaacccguaccuggcccaccuccggcgcauguacaacggcuggaccggcuccaugcgggugcgcguccugcuggcggggaacgccuucagcgccggcaaggugguggucuucugcgugccgcccggguucgacacguccuaccucacccccagccaggccacccaguucccccacgugcugaucgacguccgggcccccaagcccguggagaugccccuggaggacgugcgcaacauccucuuccaccagggcccggacucccggaugcgccugauggggaugcuguacacgccccuccgggcgaacagcggcgccgaccccuucgucgugaccggccgcgugcugaccugccccuccccgaacuucagcuucuucuuccuggucccgcccaccguggaggagcgggagccgcccuucacccuccccaaccugcccgugaacaaccugucccacagccgcgucauggagcccaucgcccagaugauguccagccggaacuuccccgccuccgugcaguuccagaacgggcgcugcacgcucagcggcgaccugcuggggaccacccccuccagccccgccgaccucggcgcguucgucggccugcgggccgagccggggucccgcgugguggagcugagccagcccaaccaggaggacuuccacgccggcagcgcccccgcccccuucggguucccggacuucuccgagugcagcgucaccuucaugguggcguccgccacgaccgugggcgagcggaccgucaacacccgcagccuccagaacuucacgcccgcccuggggcacaucaccuucgacgaggaggcccccgccgaccuguuccgggcgcgcuuccggaaccucugggagcccaccgagcacuccuucuggcgcaucccggacuaccgcgccgacgugcugggcagcgaguucgcccccuccgugagcgcccccggcgucggggagacccuccuguucuucaugugcaacgugccccggcugaacggcgcgaacccgaaccccugccccugccugcucccccaggaguggaucacgcacuucguguccgagcgcgccgcccugcagagcgacgucgcccugcucaacuacgugaacccgaacaccgggcgggugcuguucgaggccaagcuguacgcgaacggcuuccucaccgucaaccugggggccuccgaccaggccagccugcccguggacggcaucuucaaguucguguccugggucagcuucuacuaccagcuccgccccgugggcaacgccuccguggggcggcgccuguga

SEQ ID NO: 12995 - RNA, 1551 nt, Artificial Sequence
  derived and/or modified sequence opt1 from VP1__Norovirus_and/or_Norovirus-like__AF542083
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgaggugcuguucgagcuggagcucgggcccgaccugaacccguaccuggcccaccuccggcgcauguacaacggcuggaccggcuccaugcgggugcgcguccugcuggcggggaacgccuucagcgccggcaaggugguggucuucugcgugccgcccggguucgacacguccuaccucacccccagccaggccacccaguucccccacgugcugaucgacguccgggcccccgagcccguggagaugccccuggaggacgugcgcaacauccucuuccaccagggcccggacucccggaugcgccugauggggaugcuguacacgccccuccgggcgaacagcggcgccgaccccuucgucgugaccggccgcgugcugaccugccccuccccgaacuucagcuucuucuuccuggucccgcccaccguggaggagcgggagccgcccuucacccuccccaaccugcccgugaacaaccugucccacagccgcgucauggagcccaucgcccagaugauguccagccggaacuuccccgccuccgugcaguuccagaacgggcgcugcacgcucagcggcgaccugcuggggaccacccccuccagccccgccgaccucggcgcguucgucggccugcgggccgagccggggucccgcgugguggagcugagccagcccaaccaggaggacuuccacgucggcagcgcccccgcgccccucggguucccggacuucuccgacugcagcgugaccuucguggucgccuccgccacgaccgugggcgagcggaccgugaacacccgcagccugcagaacuucacgcccgcccuggggcacaucaccuucgacgaggaggcccccgccgaccucuuccgggcccacuuccgcaaccugugggagcccaccgagcacuccuucuggcggaucccggacuaccgcgcggacguccugggcagcgacuucgcccccuccgugagcgcccccggcgugggggagacccuccuguucuucaugugcaacgucccccgccugaacggcgccaacccgaaccccugccccugccuccugccccaggaguggaucacgcacuucguguccgagcgggcggcccugcagagcgacguggcccuccugaacuacgucaacccgaacaccgggcgcgugcuguucgaggccaaccucuacgccaacggcuuccugaccgugaaccugggggcguccgaccaggccacccuccccgucgacggcaucuucaaguucgugagcuggguguccuucuacuaccagcugcggcccgucggcaacgccagcguggggcgccggcuguga

SEQ ID NO: 12996 - RNA, 1551 nt, Artificial Sequence
  derived and/or modified sequence opt1 from VP1__Norovirus_and/or_Norovirus-like__EU794907
augaagaugaccgaccgcgacgugaccgacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacacguccuaccucacccccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagccgcccuucacccuccccaaccugcccgugaacaaccugucccacagccgcgugauggagcccaucgcccagaugauguccagccggaacuuccccgccuccguccaguuccagaacgggcgcugcacgcucagcggcgaccugcuggggaccacccccuccagccccuccgaccucggcgccuucgugggccugaucgcggagccggggagccgggucguggagcugagccagcccaaccaggaggacuuccacgccggcuccgcccccgcccccuucggguucccggacuucagcgacugcucccucaccuucguggucgccagcgcgacgaccgugggcgagcgcaccgugaacgcccggagcccccagaacuucacccccgcccuggggcacaucacguucgacgaggaggcccccgccgaccuguuccgcgcgcaccuccggaaccugugggacccgaccgagcacuccuucuggcgcauccccgacuaccgggccgacguccugggcuccgaguucgcccccagcguguccgcccccggcgugggggagacccuccuguucuucaugugcaacgucccgcgccugaacggcgcgaaccccaaccccugccccugccuccugccgcaggaguggaucacccacuucgugagcgagcgcgccgcccugcaguccgacguggcccuccugaacuacgucaaccccaacacggggcgggugcuguucgaggccaagcucuacgcgaacggcuuccugaccgugaaccugggggccagcgaccaggccacccuccccgucgacggcaucuucaaguucguguccugggugagcuucuacuaccagcugcgccccgucggcaacgccuccguggggcggcgccuguga

SEQ ID NO: 12997 - RNA, 1551 nt, Artificial Sequence
  derived and/or modified sequence opt1 from VP1__Norovirus_and/or_Norovirus-like__AY126474
augaagaugaccgaccgcgacaccaucgacagcgcccccgcccugggccaggugcucccgcccgaggucgaggcguccgugcccguggagcccacggccggggccccggucgccgcccccaccgcgggccaggugaaccccaucgaccccuggaucuucgccaacuucgugcaggccccgcagggggaguucaccaucagccccaacaacaaccccggcgagauccuguucgagcuggagcucgggcccgaccugaacccguaccuggcccaccuccggcgcauguacaacggcuggaccggcuccaugcggguccgcgugcugcuggcggggaacgccuucagcgccggcaagguggucguguucugcgugccgcccggguucgacacguccuaccucacccccagccaggccacccaguucccccacguccugaucgacgugcgggcccccgagcccguggagaugccccuggaggacguccgcaacauccucuuccaccagggcccggacucccggaugcgccugauggggaugcuguacacgccccuccgggcgaacagcggcgccgaccccuucguggugaccggccgcguccugaccugccccuccccgaacuucagcuucuucuuccuggugccgcccaccguggaggagcgggagccgcccuucacccuccccaaccugcccgucaacaaccugucccacagccgcgugauggagcccaucgcccagaugauguccagccggaacuuccccgccuccgugcaguuccagaacgggcgcugcacgcucagcggcgaccugcuggggaccacccccuccagccccgccgaccucggcgcguucgucggccugaucgccgagccggggucccggguggucgagcugagccagcccaaccaggaggacuuccacgccggcagcgcccccgcccccuucggguucccggacuucuccgagugcagccucaccuucgugguggcguccgccacgaccgucggcgagcgcaccgugaacacccggagccugcagaacuucacgcccgcccuggggcacaucaccuucgacgaggaggcccccgccgaccucuuccgcgcgcaccuccggaaccugugggaccccaccgagcacuccuucuggcgcaucccggacuaccgggccgacgugcugggcagcgaguucgcccccuccgucagcgcccccggcgugggggagacccugcuguucuucaugugcaacgugccccgccucaacggcgcgaacccggggcugugccccugccugcucccccaggaguggaucacgcacuucgucuccgagcgcgccgcccugcagagcgacguggcccugcucaacuacgugaaccccaacaccggccggguccuguucgagugcaagcuguacgccaacggguuccucaccgugaaccugggcgcguccgaccaggccacccugccgguggacggcaucuucaaguucgucagcuggguguccuucuacuaccagcuccgccccguggggaacgccagcgucggccggcgccuguga

SEQ ID NO: 12998 - RNA, 1551 nt, Artificial Sequence
  derived and/or modified sequence opt1 from VP1__Norovirus_and/or_Norovirus-like__JX145650
augaagaugaccgaccgcgacaucguggacagcgcccccgcccugggccagguccucccgcccgagguggaggcguccgugcccgucgagcccaccgccggggccccgguggccgccagcacggcgggccgggugaaccccaucgaccccuggaucuucgccaacuucguccaggcgccccagggggaguucaccaucuccccgaacaacaaccccggcgagauccuguucgagcuggagcucgggcccgaccugaaccccuaccuggcccaccuccgccggauguacaacggcuggaccggcagcaugcgcgugcgggugcugcuggccgggaacgccuucuccgccggcaaggucgugguguucugcgucccgcccggguucgacaccagcuaccucacgcccucccaggccacccaguucccccacgugcugaucgacgugcgcgccccggagcccgucgacaugccccuggaggacgugcggaacauccucuuccaccagggccccgacagccgcaugcggcugauggggaugcuguacaccccgcuccgcgcgaacuccggcgccgaccccuucguggucaccggccgggugcugacgugccccagccccaacuucuccuucuucuuccuggugccgcccaccgucgaggagcgcgagccgcccuucacccuccccaaccugcccgugaacagccugucccacagccgggugauggagcccaucgcccagaugauguccagccgcuccuucccggccagcguccaguuccagaacgggcggugcacccucuccggcgaccugcuggggacgacccccagcagccccgccgaccucggcgcguucgugggccugaucgccgagcccgggucccgcgucguggagcugagccagccgaaccaggaggacuuccacgccggcuccgcccccgcccccuucggguuccccgacuucagcgagugcuccgugaccuucgucguggcgagcgccaccacggugggcgagcggaccgucaacgcccgcaacccgcagaacuucacccccgcccucgggcacaucaccuucgacgaggaggcccccgcggaccuguuccgggcccgcuuccggaaccugugggagcccacggagcacuccuucuggcgcaucccggacuaccgcgccgacgugcucggcagcgacuucgcccccuccgugagcgcgcccggcgucggggagacccugcuguucuucaugugcaacgugccccggcucaacggcgccaacccgaaccccugccccugccugcugccccaggaguggaucacccacuucguguccgagcgcgccgcccuccagagcgacgucgcccugcugaacuacgugaacccgaacaccgggcggguccucuucgaggcgaagcuguacgccaacggcuuccugacggugaaccucggggccuccgaccaggccauccugcccguggacggcaucuucaaguucgugagcugggucuccuucuacuaccagcugcgccccgugggcaacaucagcguggggcggcgccucuga

SEQ ID NO: 12999 - RNA, 1548 nt, Artificial Sequence
  derived and/or modified sequence opt1 from VP1__Norovirus_and/or_Norovirus-like__AY549161
augaagaugaccgaccgcgacaccacggacagcgcccccgcccugggccaggugcucccgcccgaggucgaggcguccgugcccguggagcccaccgccggggccccggucgccgccgcgaccgccggccaggugaaccccaucgaccccuggaucuucgccaacuucgugcaggcgccccagggggaguucaccaucagcccgaacaacaaccccggcgagauccuguucgagcuggagcucgggcccgaccugaaccccuaccuggcccaccuccggcgcauguacaacggcuggacgggcuccaugcggguccgcgugcugcuggccgggaacgccuucagcgccggcaagguggucguguucugcgugccgcccggguucgacgccuccuaccucacccccagccaggcgacccaguucccccacguccugaucgacgugcgggccccggagcccguggagaugccccuggaggacguccgcaacauccucuuccaccagggccccgacucccggaugaagcugauggggaugcuguacaccccgcuccgcgccaacagcggcgccgaccccuucguggugacgggccggguccugaccugccccucccccaacuucagcuucuucuuccuggugccgcccaccguggaggagcgcgaggcccccuucacccuccccaaccugccggucaacucccugagccacucccgguacguggggcccaucaugcagaugaugagcucccgcacguuccccgcgagcgugcaguuccagaacggccggugcacccucuccggggaccugcugggcaccaccccgagcuccagcgccgaccucggcgccuucgucgggcugaucgccgaggccggcagccgcguggucgagcugucccagcccaaccaggaggacuuccacgcggggagcgcccccgcgccccucggcuucccggacuucuccgacugcagccugacguucgugguggccucccugaccaccgucggggagcggaccgugaacgcccgcagccuccagaacuucacgcccgcccugggccacgugaccuucgacgaggaggcccccgccgaccuguuccgggcccgccuccggaaccugugggaccccaccgagcacuccgucuggcgcaucccggacuaccgggcggacgugcugggcagcgaguucgcccccuccgugagcgcccccggggucggcgagacccuccuguucuucaugugcaacgugccccaccagacgggggccaacccgaaccccugccccugccugcucccccaggaguggaucacccacuucguguccgagcgcgccgcgcugcagagcgaggucgcccugcucaacuacgugaacccgaacaccggccgcgugcuguucgagugcaagcuguacgccaacggguuccucaccgucaaccugggcgccuccgaccaggugagccugcccguggacggcaucuucaaguucgucuccugggugagcuucuacuaccagcuccggcccguggggaacacgggcgucgggcgccgguga

SEQ ID NO: 13000 - RNA, 1548 nt, Artificial Sequence
  derived and/or modified sequence opt1 from VP1__Norovirus_and/or_Norovirus-like__AY549164
augaagaugaccgaccgcgacgccguggacagcgcccccgcgcugggccagguccucccgcccgagguggaggccuccgugcccgucgagcccaccgccggggccccgguggccgcgcccacggccggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcgcaccuccggcgcauguacaacggcuggaccggcuccaugcgggugcgcgugcugcuggccgggaacgccuucagcgccggcaaggucgugguguucugcgucccgcccggguucgacaccuccuaccucacgcccagccaggccacccaguucccccacgugcugaucgacgugcgggcgcccgagcccgucgagaugccccuggaggacgugcgcaacauccucuuccaccagggcccggacucccggaugcgccugauggggaugcuguacacgccccuccgggccaacagcggcgccgaccccuucguggucaccggccgcgugcugaccugccccuccccgaacuucagcuucuucuuccuggggccgcccaccguggaggagcgggagccccucuucacccugcccaaccugcccgucaacaaccucucccacagccgcgugauggagcccaucgcccagaugauguccagccgguccuucccggccagcgugcaguuccagaacggccgcugcacccuguccggggaccugcucggcacgacccccagcucccccgcggaccugggcgccuucgucgggcugcgggccgagcccggcagccgcguggucgagcucagccagccgaaccaggaggacuuccacgccggguccgcccccgcgcccuucggcuuccccgacuucagcgacugcuccgugaccuucguggucgccaacgccaccacggugcaggagugcaccgugaacacccggaacccgcagaacuucacccccgcccuggggcacaucacguucgacgaggaggcccccgcggaccuguuccgcgcccgguuccgcaaccucugggaccccaccgagcacagcuucuggcggaucccggacuaccgcgccgagguccugggcuccgacuucgcccccagcguguccgcgcccggcgugggggagacccuccucuucuucaugugcaacgucccccgcagcaacggcgccaacccgaaccccugccccugccugcugccccaggaguggaucacccacuucguguccgagcgggccgcccuccagagcgacguggcccugcugaacuacgucaacccgaacacggggcgcgugcuguucgaggcgaagcuguacgccaacggcuuccugaccgugaaccucggggccuccgaccaggccacccugcccgucgacggcaucuucaaguucgugagcuggguguccuucuacuaccagcugcggcccgucggcaacaccagcguggggcgccgguga

SEQ ID NO: 13001 - RNA, 1548 nt, Artificial Sequence
  derived and/or modified sequence opt1 from VP1__Norovirus_and/or_Norovirus-like__AY126476
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacacguccuaccucacccccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagccgcccuucacccuccccaaccugcccgugaacaaccugucccacagccgcgugauggagcccaucgcccagaugauguccagccgguccuuccccgccagcguccaguuccagaacgggcgcugcacgcucuccggcgaccugcuggggaccacccccagcucccccgccgaccucggcgcguucgugggccugcgggccgagccggggagccgcgucguggagcugagccagcccaaccaggaggacuuccacgccggcuccgcccccgcccccuucggguucccggacuucagcgacugcuccgugaccuucgucguggcgagcgccacgaccgugcaggagugcaccgucaacacccggaaccuccagaacuucacgcccgcccugggccacaucaccuucgacgaggaggcccccgccgaccuguuccgcgcgcgguuccgcaaccucugggaccccaccgagcacucccuguggcggaucccggacuaccgcgccgaggugcuggggagcgacuucgcccccuccgugagcgcccccggcgucggcgagacccuccuguucuucaugugcaacgugccccgcuccaacggggcgaacccgaaccccugccccugccugcucccccaggaguggaucacgcacuucgugagcgagcgggccgcccugcaguccgacgucgcccugcucaacuacgugaacccgaacaccggccgcgugcuguucgaggccaagcuguacgcgagcggguuccucaccgucaaccugggcgccuccgaccaggccacccugcccguggacgggaucuucaaguucgugagcugggucuccuucuacuaccagcuccggcccgugggcaacacgagcgugggccgccgguga

SEQ ID NO: 13002 - RNA, 1548 nt, Artificial Sequence
  derived and/or modified sequence opt1 from VP1__Norovirus_and/or_Norovirus-like__EU794905
augaagaugaccgaccgcgacaccaucgacagcgcccccgcccugggccaggugcucccgcccgaggucgaggcguccgugcccguggagcccacggccggggccccggucgccgcccccaccgcgggccaggugaaccccaucgaccccuggaucuucgccaacuucgugcaggccccgcagggggaguucaccaucagccccaacaacaaccccggcgagauccuguucgagcuggagcucgggcccgaccugaacccguaccuggcccaccuccggcgcauguacaacggcuggaccggcuccaugcggguccgcgugcugcuggcggggaacgccuucagcgccggcaagguggucguguucugcgugccgcccggguucgacacguccuaccucacccccagccaggccacccaguucccccacguccugaucgacgugcgggcccccgagcccguggagaugccccuggaggacguccgcaacauccucuuccaccagggcccggacucccggaugcgccugauggggaugcuguacacgccccuccgggcgaacagcggcgccgaccccuucguggugaccggccgcguccugaccugccccuccccgaacuucagcuucuucuuccuggugccgcccaccguggaggagcgggagacccccuucacgcuccccaaccugcccgucaacucccugagccacucccgcgccauggagcccaucgcccagaugaugagcucccggaacuucccggccagcgugcaguuccagaacgggcgcugcacccucuccggcgaccugcuggggaccacccccagcucccccgcggacgugggcacguucgucggccucaucgccgagcccgggagccacguggucgagcugagccagccgaaccaggaggacuuccacgccggcuccgcccccgcccccuucggguuccccgacuucagcgacugcucccugaccuucgugguggcgagcgccuccaccgucggcgagcggaccgugaacacgcgcagcccgcagaacuucacccccgcccucgggcacaucaccuucgacgaggaggcccccgccgaccuguuccgggcgcaccuccgcaaccucugggaccccaccgagcacuccuucuggcggaucccggacuaccgcgccgacgugcugggcggcgaguucgcccccagcgucuccgcccccggggugggcgagacgcugcuguucuucaugugcaacgugccccggagcaacggggcgaacccgaaccccugccccugccugcugccccaggaguggaucacccacuucgucuccgagcgcgccgcccuccagagcgacguggcccugcugaacuacaucaacccgaacaccggccgcguccucuucgagugcaagcuguacgccaacggguuccugaccgugaaccucggcgcguccgaccaggccacgcugcccguggacggcaucuucaaguucgugagcugggucuccuucuacuaccagcugcggcccguggggaacaucggcguggggcgccgguga

SEQ ID NO: 13003 - RNA, 1548 nt, Artificial Sequence
  derived and/or modified sequence opt1 from VP1__Norovirus_and/or_Norovirus-like__EU794906
augaagaugaccgaccgcgacaccaucgacagcgcccccgcccugggccaggugcucccgcccgaggucgaggcguccgugcccguggagcccacggccggggccccggucgccgcccccaccgcgggccaggugaaccccaucgaccccuggaucuucgccaacuucgugcaggccccgcagggggaguucaccaucagccccaacaacaaccccggcgagauccuguucgagcuggagcucgggcccgaccugaacccguaccuggcccaccuccggcgcauguacaacggcuggaccggcuccaugcggguccgcgugcugcuggcggggaacgccuucagcgccggcaagguggucguguucugcgugccgcccggguucgacacguccuaccucacccccagccaggccacccaguucccccacguccugaucgacgugcgggcccccgagcccguggagaugccccuggaggacguccgcaacauccucuuccaccagggcccggacucccggaugcgccugauggggaugcuguacacgccccuccgggcgaacagcggcgccgaccccuucguggugaccggccgcguccugaccugccccuccccgaacuucagcuucuucuuccuggugccgcccaccguggaggagcgggagacccccuucacgcuccccaaccugcccgucaacucccugagccacucccgcgugauggagcccaucgcccagaugaugagcucccggaacuucccggccagcgugcaguuccagaacgggcgcugcacccucuccggcgaccugcuggggaccacccccagcucccccgccgaccucggcacguucgucggccugaucgcggagcccgggagccacguggccgagcugagccagccgaaccaggaggacuuccacgccggcuccgcccccgcccccuucggguuccccgacuucagcgagugcucccucaccuucgucguggcgagcgccuccaccgugggcgagcggaccgucaacacgcgcagccugcagaacuucaccccggcccuggggcacaucaccuucgacgaggaggcccccgccgaccucuuccgggcgcaccuccgcaaccugugggaccccaccgagcacuccuucuggcggauccccgacuaccgcgccgacgugcucggcggcgaguucgccccgagcguguccgcccccggggucggcgagacgcugcuguucuucaugugcaacgugccccggcucaacggggcgaaccccaacccgugccccugccugcugccccaggaguggaucacccacuucgugagcgagcgcgccgcccuccaguccgacgucgcccugcugaacuacaucaaccccaacaccggccgcgugcuguucgagugcaagcuguacgugaacggguuccugaccgucaaccucggcgccagcgaccaggcgacgcugccgguggacggcaucuucaaguucguguccugggucagcuucuacuaccagcugcggcccguggggaacaucggcguggggcgccgguga

SEQ ID NO: 13004 - RNA, 1548 nt, Artificial Sequence
  derived and/or modified sequence opt1 from VP1__Norovirus_and/or_Norovirus-like__AY126475
augaagaugaccgaccgcgacaccgccgaccccgccccggcgcugggccaggugcucccgcccgaggucgaggccagcgugcccguggagcccacggccggggcccccgucgccgcgcccaccgccggccaggugaaccccaucgacccguggaucuucgccaacuucgugcaggcgccccagggggaguucaccaucucccccaacaacaaccccggcgagauccuguucgagcuggagcucgggccggaccugaaccccuaccuggcccaccuccggcgcauguacaacggcuggaccggcagcaugcggguccgcgugcugcuggccgggaacgccuucuccgccggcaagguggucguguucugcgugccgcccggguucgacacgagcuaccucacccccucccaggccacccaguucccccacguccugaucgacgugcgggugcccgagcccgucgagaugccgcuggaggacgugcgcaacauccucuuccaccagggccccgacagccggaugcgccugauggggaugcuguacacgccccuccgggcgaacuccggcgccgaccccuucguggucaccggccgcgugcugaccugcccgagccccaacuucuccuucuucuuccuggugccgcccaccgucgaggagcgggagccgcccuucacccuccccaaccugcccgugaacaaccugagccacucccgcgugauggagcccaucgcccagaugaugagcucccggagcuuccccgccuccguccaguuccagaacgggcgcugcacgcucagcggcgaccugcuggggaccacccccuccagcccggccgaccucggcgcguucgugggccugaucgccgagcccgggucccgggucguggagcuguuccagcccaaccaggaggacuuccacgccggcagcgcccccgccccguucggguuccccgacuucagcgagugcuccgugaccuucgucgugagcuccgcgacgaccgugggcgagcgcaccgucaacgcccggaaccagcagaacuucacccccgcccucgggcacaucacguucgacgaggaggcccccgccgaccuguuccgcgcgugcuuccggaaccugugggagccgaccgagcacagcuucuggcgcauccccgacuaccgggccgacgugcucggcuccgacuucgcccccagcguguccgcccccggcgucggggagacccugcuguucuucaugugcaacgugccgcgccucaacggcgugaaccccgggcccugccccugccugcugccgcaggaguggaucacccacuucgucagcgagcgcgcggcccuccaguccgacguggcccugcugaacuacgugaaccccaacacgggccggguccucuucgaggccaagcuguacgccaacggguuccugaccgugaaccucggcgcgagcgaccaggccacccugcccguggacggcaucuucaaguucgucuccugggugagcuucuacuaccagcugcgccccguggggaacaccuccgucggccggcgcuga

SEQ ID NO: 13005 - RNA, 1548 nt, Artificial Sequence
  derived and/or modified sequence opt1 from VP1__Norovirus_and/or_Norovirus-like__AF542084
augaagaugaccgaccgcgacaccguggacagcgcccccgcccugggccagguccucccgcccgagguggaggcguccgugcccgucgagcccacggccggggccccgguggccgcccccaccgcgggccaggugaaccccaucgaccccuggaucuucgccaacuucguccaggccccgcagggggaguucaccaucagccccaacaacaaccccggcgagauccuguucgagcuggagcucgggcccgaccugaacccguaccuggcccaccuccggcgcauguacaacggcuggaccggcuccaugcgggugcgcgugcugcuggcggggaacgccuucagcgccggcaaggucgugguguucugcgucccgcccggguucgacacguccuaccucacccccagccaggccacccaguucccccacgugcugaucgacgugcgggcccccgagcccgucgagaugccccuggaggacgugcgcaacauccucuuccaccagggcccggacucccggaugcgccugauggggaugcuguacacgccccuccgggcgaacagcggcgccgaccccuucguggucaccggccgcgugcugaccugccccuccccgaacuucagcuucuucuuccuggugccgcccaccgucgaggagcgggagccccucuucacccugcccaaccugcccgugaacaaccucucccacagccgcgugauggagcccaucgcccagaugauguccagccggaacuucccggccuccguccaguuccagaacgggcgcugcacgcugagcggcgaccugcucgggaccacccccuccagccccgccgaccugggcgcguucgugggccugcgggccgagcccgggucccgcgucguggagcucagccagccgaaccaggaggacuuccacgccggcagcgcccccgcgccccugggguuccccgacuucuccgacugcagcgugaccuucgucguggccaacgccacgaccgugcaggagugcaccgucaacacccggaacccgcagaacuucacgcccgcccugggccacaucaccuucgacgaggaggcccccgccgaccucuuccgcgcgcacuuccggaaccugugggaccccaccgagcacuccuucuggcgcaucccggacuaccgggccgaggugcuggggagcgacuucgcccccuccgugagcgcccccggcgucggcgagacccuccuguucuucaugugcaacgugccccgcuccaacggggcgaacccgaaccccugccccugccugcucccccaggaguggaucacgcacuucgugagcgagcgcgccgcccugcaguccgacgucgcccugcucaacuacgugaacccgaacaccggccgggugcuguucgaggccaagcuguacgcgaacggguuccucaccgucaaccugggcgccagcgaccaggccacccugcccguggacgggaucuucaaguucguguccugggucagcuucuacuaccagcuccgccccgugggcaacacguccgugggccggcgcuga

SEQ ID NO: 13006 - RNA, 1536 nt, Artificial Sequence
  derived and/or modified sequence opt1 from VP1__Norovirus_and/or_Norovirus-like__KC695807
auggcccuggagcccguggucggcgccgcgaucgccgccccgguggccgggcagcagaacgugaucgaccccuggauccgcaacaacuucguccaggcccccggcggggaguucaccgugagcccccggaacgcgccgggcgagauccucugguccgcgccccuggggcccgaccugaaccccuaccucagccaccuggcccgcauguacaacggcuacgccggcggguucgaggugcaggucauccuggccggcaacgccuucaccgccgggaaggugaucuucgccgccgugccgcccaacuuccccacggagggccucucccccagccaggucaccauguucccgcacaucgugguggacguccggcagcuggagcccgugcugaucccccuccccgacgugcgcaacaacuucuaccacuacaaccaguccaacgacccgaccaucaagcugaucgcgaugcuguacacgccccuccgggccaacaacgccggggacgacgucuucaccgugagcugccgcgugcugacccggcccucccccgacuucgacuucaucuuccuggucccgcccaccguggagagccgcaccaagcccuucuccgugcccguccucacgguggaggagaugaccaacagccgguucccgaucccccuggagaagcuguucaccggccccuccagcgccuucgugguccagccccagaacggccgcugcaccacggacggggugcuccugggcaccacccagcuguccccggucaacaucugcaccuuccgcggggacgugacgcacaucaccggcagccggaacuacaccaugaaccucgccucccagaacuggaacaacuacgaccccaccgaggagauccccgcgccgcugggcgcccccgacuucguggggaagauccagggcaugcugacgcagaccacccgggccgacgggagcacccgcggccacaaggccacggucuacaccggguccgccgacuucgcgcccaagcucggccgggugcaguucgagaccgacaccgaccacgacuucgaggccaaccagaacacgaaguucacccccgugggcgucauccaggacgggagcaccacccaccgcaacgagccgcagcagugggugcugcccuccuacagcggccggaacacgcacaacgugcaccuggcccccgccgucgcccccaccuucccgggggagcagcuccuguucuuccgcagcaccaugcccggcugcuccggguaccccaacauggaccuggacugccuccugccccaggagugggugcaguacuucuaccaggaggcggccccggcccagagcgacguggcccugcuccgguucgucaaccccgacaccggccgcgugcuguucgagugcaagcugcacaaguccggcuacgugacggucgcgcacaccgggcagcacgaccucgugaucccgcccaacggcuacuuccgguucgacagcugggugaaccaguucuacacccuggcccccauggggaacggcaccgggcgccgcuga

SEQ ID NO: 13007 - RNA, 807 nt, Artificial Sequence
  derived and/or modified sequence opt1 from VP2_capsid_protein__Norovirus__AGL98415
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgacgccacccacaagcuccagcagggccugaugcagaucaagcaggcggugcugcucgagggcggguucuccgccgccgacgccgcccgcggggcgaucaacgcccccaugaccaaggcccuggacuggagcggcacgcgguacugggccccggaggcccgggugaccaccuacaacgcggggcacuucucccccagccagcccucccgcgcccccagcggccggaucaacuccggcaccccgacgcccgcccgcaacagccugaacucccccgccaccagcuccgucgccaccagcgugcacuccaaccagaccgcgagcacgcggaucgggagcuccgccggcagcgggaccuccgugagcucccuccccagcaccucccgcacccggaacugggucgaggaccagaaccgcagcguguccccguucaugcggggcgcccugaacacgagcuucgugaccccgcccuccagccgcuccagcaaccaguccaccgucagcaccgugcccaaggagauccuggacuccuggacgggcgccuucaacacccggcgccagccccucuucgcccacauccggcgccgcggggagagccggguguga

SEQ ID NO: 13008 - RNA, 792 nt, Artificial Sequence
  derived and/or modified sequence opt1 from VP2_capsid_protein__Norovirus__AGL98417
auggccggcgccuucuucgcggggcuggccagcgacgugcucggcaccgggcugggcucccugaucggggccggcgccggcgccaucaaccagaaggucgaguacgagaacaaccgcaagcuccagcaggcgagcuuccaguucuccagcgaccugcagcaggccuccuuccagcacgacaaggacaugcugcaggcccagaucaaggccacccagaagcuccagcacgaccugaugcgggugaagcaggcggugcugcucgagggcggguucagccccacggacgccgcccgcggggccaucaacgccccgaugaccaagguccuggacugguccggcacccgguacugggcgcccggggcccgcgugaccacgagcaacgccggccaguucuccuucagccagcccauccgggagcccuccggccgcaccgccccggcccggagccccgcgaaccgcgccuccagcguguccgcccccagcuccacccugagcaaccagaccacguccacccggcucgggaccagcgccggcagcggggccuccgucagcggcuccagcuccgcgagccgcgugcgguccuggguggagggccagaaccgcagccugucccccuucauggacggggcccugcacaccagcuucgucacgccgcccuccagcaaguccagcucccagggcaccgugagcaccgugcccaaggagguccucgacuccuggaccggggccuucaacacgcaccggcagccccuguucgcccacgugcgccggcagggcgagagccgcguguga

SEQ ID NO: 13009 - RNA, 648 nt, Artificial Sequence
  derived and/or modified sequence opt1 from capsid_protein_VP2__Norovirus__AFI08232
auggcccaggccgugcugggcgcgaucgccgccaccgccgccgggagcgcggucggcgccgggauccaggccggcaccgaggccgcgcuccagcaccagcgcuuccagcaggaccugacgcugcaguccaacaccuucaagcacgacaaggagaugcucgccaugcaggucgaggccagcaccucccugcugcagaacagccucaacacccgguacaaccugcugacgcaggccgggcucaccuccgccgacgcggcccgcgccguggccggcgcccccgugacccgggugguggacuggaacggcacccgcaucgcggccccgcugagcacggccaccacccugcgguccgggggcuucaugagcauccccgucauguaccgcggggccaagaccgagcagcagaagcucacgggcuucuccaaccccaacuacgagaccgggagcuccgugagccggaccucccagugggugagcucccagaacagcaugcgcuccagcgucgcccccuuccacccggacgcgcugcggaccacgugggugaccccgcccggcuccagcagcaccuccaccgugagcuccgccagcuccaucccccgcuucuucaacacggagcggcugccccucuucgccaacaacaagcgcuga

SEQ ID NO: 13010 - RNA, 807 nt, Artificial Sequence
  derived and/or modified sequence opt1 from capsid_protein_VP2__Norovirus__AFI08235
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggcgcucgacuggagcgggacccgcuacugggccccggacgcccggaccaccacguacaacgccggccgcuucuccacgccccagcccagcggggcccugcccggccggaucaacccgcgcacccccacccccgcgcggggcuccagcuccaccagcuccaacgccagcaccgccaccuccauccacagcaaccagaccguguccacgcgccuggggagcaccgccggcagcgggaccaacguguccagccuccccuccaccgcccggacgcgcagcugggucgaggaccagaaccggaaccuguccccguucaugcgcggcgcgcacaacaucagcuucgugaccccgcccuccagccgguccagcucccagggcaccgugagcaccguccccaaggaggugcugaacuccuggacgggggccuucaacacccgccggcagccccucuucgcccacauccgccggcagggcgagagccgcguguga

SEQ ID NO: 13011 - RNA, 807 nt, Artificial Sequence
  derived and/or modified sequence opt1 from capsid_protein_VP2__Norovirus__AFI08238
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccacagcaaccagacgguguccacccgccuggggagcaccgccggcagcggggccaacgucuccagccuccccuccaccgcccggacgcgcagcuggguggaggaccagaaccggaaccuguccccguucaugcgcggcgcccacaacaucagcuucgugaccccgcccuccagccgguccagcucccagggcaccgucagcaccgugcccaaggaggugcuggacuccugggcgggggccuucaacacgcgccggcagccccucuucgcccacauccgccggcgcggcgagagccgggucuga

SEQ ID NO: 13012 - RNA, 807 nt, Artificial Sequence
  derived and/or modified sequence opt1 from capsid_protein_VP2__Norovirus__AFI08241
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaccaacccgcgcacccccacccccgcccggggcuccagcuccgccagcuccaacgcgagcaccgccaccuccauccugagcaaccagacggccuccacccgccucgggagcaccgccggcagcgggaccaacguguccagccugcccuccacggcccggacccgcagcugggucgaggaccagaaccggaaccuguccccguucaugcgcggcgcgcacaacaucagcuucgugaccccgcccuccagccgguccagcucccagggcaccgugagcacgguccccaaggaggugcucgacuccuggaccggggccuucaacacccgccggcagccccuguucgcccacauccgccggcgcggcgagagccggguguga

SEQ ID NO: 13013 - RNA, 807 nt, Artificial Sequence
  derived and/or modified sequence opt1 from capsid_protein_VP2__Norovirus__AFI08244
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacgcacaacgccggccgcuucuccacgccccagcccagcgggacccugcccggccggaucaacccgcgcacccccacccccgcccggggcuccagcaacaccuccagcaacgccuccaccgcgaccagcauccacuccaaccagacggugagcacccgccugggguccaccgccggcagcgggaccaacgucagcucccuccccagcacggcccggacccgcuccuggguggaggaccagaaccggaaccugagcccguucaugcgcggcgcccacaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13014 - RNA, 807 nt, Artificial Sequence
  derived and/or modified sequence opt1 from capsid_protein_VP2__Norovirus__AFJ38520
auggccggccccuucuucgccgggcuggcgagcgacgugcucggcuccgggcugggcagccugaucaacgccggggccggcgccaucaaccagaaggucgaguucgagaacaaccgcaagcuccagcaggccuccuuccaguucagcuccaaccugcagcaggcgagcuuccagcacgacaaggagaugcugcaggcccagaucgaggccacccagaagcuccagcagggccugaugaaggugaagcaggccgugcugcucgagggcggguucuccaccacggacgcggcccgcggggccaucaacgccccgaugaccaaggcccuggacuggagcggcacccgguacugggcgcccgacgcccgggccaccacguacaacgccgggcgcuucuccacgccccagccccugggcgcccucccgggccggaucaacccccgcguccccgcgcccgcccggagcuccccgagcucccugagcaacgcccccaccgccaccuccguguacagcaaccagaccguguccacccgccuggggagcuccgccggcagcggggcgggcgucagcucccuccccagcaccgcccggacccgcuccuggguggaggaccagaaccggaaccugagccccuucaugcgcggcgcccugaacacguccuucgugaccccgcccagcucccggagcuccaaccaggggaccgucagcaccgugcccaaggagauccucgacuccuggacgggcgccuucaacacccgccggcagccccuguucgcccacauccgcaagcgcggggagagccggguguga

SEQ ID NO: 13015 - RNA, 765 nt, Artificial Sequence
  derived and/or modified sequence opt1 from capsid_protein_VP2__Norovirus__AFX71657
auggccggcgccuucaucgcggggcuggccggcgacaugcugaccagcaccguggggucccuggucaacgccggcgccagcgccaucaaccagaagguggacuucgagaacaacaaguaccugcagaacgcguccuucaaccacgacaaggagaugcucaacgcccagaucgaggccacgaagcgccugcaggccgacaugaucgcgaucaagcagggggugcugaccgccggcggcuucagccccaccgacgccgcccgcggggccaucaacgcgccgaucacccggguccucgacugguccggcacgcgguacugggcccccaacgccaccagcaccaccuccaugagcgggggcuucacgucccagaccgugcaccgcaccacccccaacuucaagacgaaccaggcccccaagagcaccccguccagcggguccagcgugcgguccaacagcacccagcugaccucccugagcucccacagcagcggcuccagccgcuccagcggcuccacggucgugagcucccuccccagcuccaaccggacccgcgacugggugaaccagcagaacuucaaccuggagccccacaugcccgggagccugcggaccgccuucgucaccccgcccuccagcacggcguccaacagcgacaccguguccaccgugcccaagagcguccucgacuccuggaccagcgccuucaacacgcgccggcagccccuguucgcccaccuccgccggcgcggcgaguccaacguguga

SEQ ID NO: 13016 - RNA, 780 nt, Artificial Sequence
  derived and/or modified sequence opt1 from capsid_protein_VP2__Norovirus__AFX71660
auggccggcgccuucguggcggggcuggccggcgacguccugagcaacgggcuguccagccugaucaacgccggcgccaacgccaucaaccagcgcgcggaguucgacuucaaccagcggcuccagcagaacuccuucaaccacgacaaggagaugcugcaggcccagauccaggccaccaagcagcugcaggccgacaugauggcgaucaagcagggggugcucaccgccggcggcuucagccccacggacgccgcccgcggggccgugaacgcgccgaugacccaggcccuggacuggaacggcacccgguacugggcccccggguccaugcgcaccacgagcuacuccggccgguucaccagcaccgcccccgcccgccaggcggacuuccagcacacccagaaccggcccuccagcggguccagcgucuccagcuacacgacccaguccagccgcccgacccugaccacgaccaccggcuccagccacggcaccacguccagcaacagcacccgguccaccaaccucagccaguccaccgugagccgcgccacgucccggaccagcgagugggugcgcgaccagaaccggaaccuggagcccuacaugcacggggcccugcagaccgccuucgucaccccgcccuccagccgcgccuccgacggcacggugagcaccgugcccaaggggguccucgacuccuggacccccgcguucaacacccggcgccagccccuguucgcccaccuccggaagcgcggcgagagccggguguga

SEQ ID NO: 13017 - RNA, 780 nt, Artificial Sequence
  derived and/or modified sequence opt1 from capsid_protein_VP2__Norovirus__AFX71666
auggccggcgccuucuucgcggggcuggccggcgacguggucagcaacgggaucggcucccugaucaacgccggggccaacgccgugaaccagaagguggaguacgacuucaacaagcagcugcagauggcgagcuucaagcacgacaaggagaugcugcagucccagguccucgccaccaagcagcugcagcaggagaugaugaacauccgccagggcgugcugaccgccggcggguucagccccgccgacgcggcccggggcgccgugaacgccccgaugacgaagauccucgacuggaacgggacccgcuacugggcccccaacuccaugaagaccaccagcuacuccggccaguucagcuccagccccguccaccggcccccggcggcgccccagcacacggccccgcccaaguccaagcugcagggggacagcguguccguguacagcucccccagcaccgucuccagccaguccacccacagcaccgugcugagcgccggcacgggcuccagccgcuccaccagcaccuccaccgccgccagcacgcucucccggaccagcgacugggugcgcgggcagaacgagcggcugucccccuucauggacggcgcccugcagaccaccuucgucacgccgcccagcuccaaggccagcuccaacgggaccgugagcaccgugcccaaggccguccucgacuccuggacccccacguucaacacccaccgccagccccuguucgcccaccuccggcgccggggcgagagccagaucuga

SEQ ID NO: 13018 - RNA, 807 nt, Artificial Sequence
  derived and/or modified sequence opt1 from capsid_protein_VP2__Norovirus__AFX71669
auggccggcgccuucuucgcggggcuggccagcgacgugcucggcuccgggcugggcagccugaucaacgccggggccggcgucaucaaccagaagguggacuucgagaacaaccgcaagcuccagcaggccuccuuccaguucagcuccaaccagcagcaggcgagcuuccagcacgacaaggagaugcugcaggcccagaucgaggccaccaagaagcugcagcaggagaugaugcgggugaagcaggccaugcuccuggagggcggguucuccgagaccgacgcggcccgcggcgccaucaacgcccccaugacgaaggcccuggacuggagcgggacccgguacugggcgccggacgcccgcaccaccacguacaacgccggccgguucuccacgccccagcccagcggggccucccccggccgcgccaaccuccgggcgaccgucccggcccgcggcagcuccagcaccuccagcaacuccagcaucgccaccuccguguacagcaaccagaccaccagcacccggcugggguccacggccggcagcgggaccuccgugagcucccugcccagcaccgcccgcaccauguccugggucgaggaccagaaccggaaccucagccccuucaugcgcggcgcgcacaacaucuccuucgugacgcccccgagcucccggagcuccagccagggcaccguguccaccguccccaaggaggugcuggacagcuggaccggggccuucaacacgcgccggcagccccuguucgcccacauccgcaagcggggcgagucccgcguguga

SEQ ID NO: 13019 - RNA, 807 nt, Artificial Sequence
  derived and/or modified sequence opt1 from capsid_protein_VP2__Norovirus__AFX81122
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaccaacccgcgcacccccacccccgcccggggcuccagcuccaccagcuccaacgccagcaccgcgacguccauccugagcaaccagaccgccuccacccgccucgggagcaccgccggcagcgggacgaacguguccagccugcccuccaccgcccggacccgcagcugggucgaggaccagaaccggaaccuguccccguucaugcgcggcgcccacaacaucagcuucgugaccccgcccuccagccgguccagcucccagggcacggugagcaccguccccaaggaggugcucgacuccuggaccggggcguucaacacccgccggcagccccuguucgcccacauccgccggcgcggcgagagccggguguga

SEQ ID NO: 13020 - RNA, 807 nt, Artificial Sequence
  derived and/or modified sequence opt1 from capsid_protein_VP2__Norovirus__AFX81125
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaucaugaaggcgaagcaggccaugcugcuggagggcggguucuccgagaccgacgccgcccggggcgccaucaacgcgcccaugacgaagguccucgacuggagcgggacccgcuacugggccccggacgcccggaccgccaccuacaacgccggccgcuucuccacgccccagcccagcgggacccugcccggccggaucaacccgcgcacccccacccccgcgcggggcuccagcuccacgagcuccaacgccagcaccgccaccuccauccacagcaaccagaccguguccacgcgccuggggagcaccgccggcagcgggaccaacguguccagccuccccuccaccgcccggacgcgcagcugggucgaggaccagaaccggaaccuguccccguucaugcgcggcgcgcacaacaucagcuucgugaccccgcccuccagccgguccagcucccagggcaccgugagcaccguccccaaggaggugcuggacuccuggacgggggccuucaacacccgccggcagccccucuucgcccacauccgccggcgcggcgagagccggguguga

SEQ ID NO: 13021 - RNA, 807 nt, Artificial Sequence
  derived and/or modified sequence opt1 from capsid_protein_VP2__Norovirus__AFX81131
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggaggucaugaaggugaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccacagcaaccagacggucuccacccgccuggggagcaccgccggcagcgggaccaacguguccagccuccccuccacggcccggacccgcagcuggguggaggaccagaaccggaaccuguccccguucaugcgcggcgcccacaacaucagcuucgucaccccgcccuccagccgguccagcucccagggcaccgugagcacggugcccaaggagguccuggacuccuggaccggggccuucaacacccgccggcagccccucuucgcgcacauccgccggcgcggcgagagccggguguga

SEQ ID NO: 13022 - RNA, 807 nt, Artificial Sequence
  derived and/or modified sequence opt1 from capsid_protein_VP2__Norovirus__AFX81134
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccacagcaaccagacgguguccacccgccuggggagcaccgccggcagcgggaccaacgucuccagccuccccuccacggcccggacccgcagcuggguggaggaccagaaccggaaccuguccccguucaugcgcggcgcccacaacaucagcuucgugaccccgcccuccagccgguccagcucccagggcaccgucagcacggugcccaaggaggugcuggacuccuggaccggggccuucaacacccgccggcagccccucuucgcgcacauccgccggcgcggcgagagccgggucuga

SEQ ID NO: 13023 - RNA, 807 nt, Artificial Sequence; identical to SEQ ID NO: 13022
  derived and/or modified sequence opt1 from capsid_protein_VP2__Norovirus__AFX81137

SEQ ID NO: 13024 - RNA, 807 nt, Artificial Sequence
  derived and/or modified sequence opt1 from capsid_protein_VP2__Norovirus__AFX81140
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccagcgccuccaccgcgaccagcauccacuccaaccagacggugagcacccgccuggggagcaccgccggcuccgggaccaacgucagcucccuccccagcacggcccggacccgcuccuggguggaggaccagaaccggaaccugagcccguucaugcgcggcgcccacaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13025 - RNA, 807 nt, Artificial Sequence
  derived and/or modified sequence opt1 from capsid_protein_VP2__Norovirus__AFX81143
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcauccccacccccgcccggggcuccagcuccaccagcuccaacgccagcaccgcgaccuccaucuacagcaaccagaccguguccacgcgccuggggagcaccgccggcagcgggaccaacgucuccagccuccccuccaccgcccggacgcgcagcuggguggaggaccagaaccggaaccuguccccguucaugcgcggcgcccacaacaucagcuucgugaccccgcccuccagccgguccagcucccagggcaccgucagcaccgugcccaaggaggugcuggacuccuggacgggggccuucaacacccgccggcagccccucuucgcgcacauccgccggcgcggcgagagccgggucuga

SEQ ID NO: 13026 - RNA, 807 nt, Artificial Sequence; identical to SEQ ID NO: 13022
  derived and/or modified sequence opt1 from capsid_protein_VP2__Norovirus__AFX81149

SEQ ID NO: 13027 - RNA, 807 nt, Artificial Sequence
  derived and/or modified sequence opt1 from capsid_protein_VP2__Norovirus__AFX81152
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcagggcaugaugaaggucaagcaggcgaugcugcuggagggcggguucuccgagaccgacgccgcccgcggggccaucaacgcccccaugacgaaggugcucgacuggagcggcacccgguacugggcgccggacgcccggaccaccacguacaacgccgggcgcuucuccacgccccagcccagcggcacccugcccggccggaucaacccgcgcacccccacccccgcccggggguccagcuccaccagcuccaacgccagcaccgcgaccuccauccacagcaaccagacgguguccacccgccugggcagcaccgccgggagcggcaccaacgucuccagccuccccuccacggcccggacccgcagcuggguggaggaccagaaccggaaccuguccccguucaugcgcggcgcccacaacaucagcuucgugaccccgcccuccagccgguccagcucccaggggaccgucagcacggugcccaaggaggugcuggacuccuggaccggcgccuucaacacccgccggcagccccucuucgcgcacauccgccggcgcggggagagccgggucuga

SEQ ID NO: 13028 - RNA, 807 nt, Artificial Sequence
  derived and/or modified sequence opt1 from capsid_protein_VP2__Norovirus__AFX81155
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccacagcaaccagacgguguccacccgccuggggagcaccgccggcagcgggaccaacguccccucccucccgagcacggcccggacccgcuccuggguggaggaccagaaccggaaccugagccccuucaugcgcggcgcccagaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13029 - RNA, 807 nt, Artificial Sequence
  derived and/or modified sequence opt1 from capsid_protein_VP2__Norovirus__AFX81158
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccugacccccgcccggggcuccagcuccaccagcuccaacgccagcaccgcgaccuccauccacagcaaccagacgguguccacccgccucgggagcaccgccggcagcgggaccaacgucuccagccugcccuccacggcccggacccgcagcuggguggaggaccagaaccggaaccugucccccuucaugcgcggcgcccacaacaucagcuucgugaccccgcccuccagccgguccagcucccagggcaccgucagcacggugcccaaggaggugcucgacuccuggaccggggccuucaacacccgccggcagccccuguucgcgcacauccgccggcgcggcgagagccgggucuga

SEQ ID NO: 13030 - RNA, 807 nt, Artificial Sequence
  derived and/or modified sequence opt1 from capsid_protein_VP2__Norovirus__AFX81164
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccaucuacagcaaccagacgguguccacccgccuggggagcaccgccggcagcgggaccaacgucuccagccuccccuccacggcccggacccgcagcuggguggaggaccagaaccggaaccuguccccguucaugcgcggcgcccacaacaucagcuucgugaccccgcccuccagccgguccagcucccagggcaccgucagcacggugcccaaggaggugcuggacuccuggaccggggccuucaacacccgccggcagccccucuucgcgcacauccgccggcgcggcgagagccgggucuga

SEQ ID NO: 13031 - RNA, 807 nt, Artificial Sequence; identical to SEQ ID NO: 13022
  derived and/or modified sequence opt1 from capsid_protein_VP2__Norovirus__AFX81173

SEQ ID NO: 13032 - RNA, 807 nt, Artificial Sequence; identical to SEQ ID NO: 13022
  derived and/or modified sequence opt1 from capsid_protein_VP2__Norovirus__AFX81179

SEQ ID NO: 13033 - RNA, 807 nt, Artificial Sequence; identical to SEQ ID NO: 13030
  derived and/or modified sequence opt1 from capsid_protein_VP2__Norovirus__AFX81182

SEQ ID NO: 13034 - RNA, 807 nt, Artificial Sequence
  derived and/or modified sequence opt1 from capsid_protein_VP2__Norovirus__AFX81185
auggccggcgccuucuucgcggggcuggccagcgacgugcucggcuccgggcugggcagccugaucaacgccggggccggcgccaucaaccagaaggucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggugaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccacagcaaccagacggucuccacccgccuggggagcaccgccggcagcgggaccaacguguccagccuccccuccacggcccggacccgcagcuggguggaggaccagaaccggaaccuguccccguucaugcgcggcgcccacaacaucagcuucgucaccccgcccuccagccgguccagcucccagggcaccgugagcacggugcccaaggagguccuggacuccuggaccggggccuucaacacccgccggcagccccucuucgcgcacauccgccggcgcggcgagagccggguguga

SEQ ID NO: 13035 - RNA, 807 nt, Artificial Sequence; identical to SEQ ID NO: 13022
  derived and/or modified sequence opt1 from capsid_protein_VP2__Norovirus__AFX81188

SEQ ID NO: 13036 - RNA, 807 nt, Artificial Sequence; identical to SEQ ID NO: 13022
  derived and/or modified sequence opt1 from capsid_protein_VP2__Norovirus__AFX81191

SEQ ID NO: 13037 - RNA, 807 nt, Artificial Sequence
  derived and/or modified sequence opt1 from capsid_protein_VP2__Norovirus__AFX81194
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccgggugaacccgcgcacccccacccccgcccggggcuccagcuccaccagcuccaacgccagcaucgcgaccuccaucuacagcaaccagaccgucuccacgcgccuggggagcaccgccggcagcgggaccaacguguccagccuccccuccaccgcccggacgcgcagcuggguggaggaccagaaccggaaccuguccccguucaugcgcggcgcccacaacaucagcuucgucaccccgcccuccagccgguccagcucccagggcaccgugagcaccgugcccaaggagguccuggacuccuggacgggggccuucaacacccgccggcagccccucuucgcgcacauccgccggcgcggcgagagccggguguga

SEQ ID NO: 13038 - RNA, 807 nt, Artificial Sequence; identical to SEQ ID NO: 13022
  derived and/or modified sequence opt1 from capsid_protein_VP2__Norovirus__AFX81197

SEQ ID NO: 13039 - RNA, 807 nt, Artificial Sequence
  derived and/or modified sequence opt1 from capsid_protein_VP2__Norovirus__AFX81200
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgugagcaccgccaccuccaucuaccugaaccagacggucagcacccgccucggguccaccgcgggcagcgggaccaacgugagcucccugcccagcacggcccggacccgcuccuggguggaggaccagaaccggaaccugagcccguucaugcgcggcgcccacaacaucuccuucgucaccccgcccagcucccggagcuccagccagggcaccguguccacggugcccaaggagguccucgacagcuggaccggggccuucaacacccgccggcagccccuguucgcccacauccgccggcgcggcgagucccggguguga

SEQ ID NO: 13040 - RNA, 807 nt, Artificial Sequence; identical to SEQ ID NO: 13030
  derived and/or modified sequence opt1 from capsid_protein_VP2__Norovirus__AFX81203

SEQ ID NO: 13041 - RNA, 807 nt, Artificial Sequence
  derived and/or modified sequence opt1 from capsid_protein_VP2__Norovirus__AFX81206
auggccggcgccuucuucgcggggcuggccagcgacgugcucggcuccgggcugagcucccugaucaacgccggcgccggggccaucaaccagaagaucgacuucgagaacaaccgcaagcuccagcaggcgagcuuccaguucuccagcaaccugcagcaggccuccuuccagcacgacaaggagaugcugcaggcccagaucgaggccaccaagaagcuccagcaggagaugaugaaggucaagcaggcgaugcugcuggagggcggcuucagcgagaccgacgccgcccgcggggccgugaacgcccccaugacgaaggugcucgacugguccggcacccgguacugggcgccggacgcccggaccaccacguacaacgccgggcgcuucagcacgccccagcccuccggcacccugcccgggcggaucaacccgcgcacccccacccccgcccggggcagcuccagcaccuccagcaacgccuccaccgcgaccagcaucuacuccaaccagacggucagcacccgccugggcagcaccgccggguccggcaccaacgugagcucccuccccagcacggcccggacccgcuccuggguggaggaccagaaccggaaccugagcccguucaugcgcggggcccacaacaucuccuucgucaccccgcccagcucccggagcuccagccagggcaccguguccacggugcccaaggagguccuggacagcuggaccggcgccuucaacacccgccggcagccccucuucgcgcacauccgccggcgcggggagucccggguguga

SEQ ID NO: 13042 - RNA, 807 nt, Artificial Sequence; identical to SEQ ID NO: 13030
  derived and/or modified sequence opt1 from capsid_protein_VP2__Norovirus__AFX81209

SEQ ID NO: 13043 - RNA, 807 nt, Artificial Sequence
  derived and/or modified sequence opt1 from capsid_protein_VP2__Norovirus__AFX81212
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccaccagcaacgccuccaccgcgacgagcauccacuccaaccagaccgugagcacccgccugggguccaccgccggcagcgggacgaacgucagcucccuccccagcaccgcccggacccgcuccuggguggaggaccagaaccggaaccugagcccguucaugcgcggcgcccacaacaucuccuucgugaccccgcccagcucccggagcuccagccagggcacggucuccaccgugcccaaggaggugcuggacagcuggaccggggccuucaacacccgccggcagccccucuucgcgcacauccgccggcgcggcgagucccgggucuga

SEQ ID NO: 13044 - RNA, 807 nt, Artificial Sequence
  derived and/or modified sequence opt1 from capsid_protein_VP2__Norovirus__AFX81215
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccgugaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgcccccaucgcgaccagcaucuacuccaaccagaccgucagcacgcgccugggguccaccgccggcagcgggaccaacgugagcucccucccgagcaccgcccggacgcgcuccuggguggaggaccagaaccggaaccugagccccuucaugcgcggcgcccacaacaucuccuucgucaccccgcccagcucccggagcuccagccagggcaccguguccaccgugcccaaggagguccuggacagcuggacgggggccuucaacacccgccggcagccccucuucgcgcacauccgccggcgcggcgagucccggguguga

SEQ ID NO: 13045 - RNA, 807 nt, Artificial Sequence; identical to SEQ ID NO: 13030
  derived and/or modified sequence opt1 from capsid_protein_VP2__Norovirus__AFX81218

SEQ ID NO: 13046 - RNA, 807 nt, Artificial Sequence
  derived and/or modified sequence opt1 from capsid_protein_VP2__Norovirus__AFX81221
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcucccccagcaccuccagcaacgccuccaccgcgaccagcaucuacuccaaccagacggugagcacccgccugggguccaccgccggcagcgggaccaacgucagcucccucccgagcacggcccggacccgcuccuggguggaggaccagaaccggaaccugagccccuucaugcgcggcgcccacaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13047 - RNA, 807 nt, Artificial Sequence; identical to SEQ ID NO: 13030
  derived and/or modified sequence opt1 from capsid_protein_VP2__Norovirus__AFX81224

SEQ ID NO: 13048 - RNA, 807 nt, Artificial Sequence; identical to SEQ ID NO: 13030
  derived and/or modified sequence opt1 from capsid_protein_VP2__Norovirus__AFX81227

SEQ ID NO: 13049 - RNA, 807 nt, Artificial Sequence
  derived and/or modified sequence opt1 from capsid_protein_VP2__Norovirus__AFX81230
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccgaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccgcccccgcccggggcuccagcuccaccagcuccaacgcgagcaccgccaccuccaucuacagcaaccagaccguguccacgcgccuggggagcaccgccggcagcgggaccaacgucuccagccuccccuccaccgcccggacgcgcagcuggguggaggaccagaaccggaaccuguccccguucaugcgcggcgcccacaacaucagcuucgugaccccgcccuccagccgguccagcucccagggcaccgucagcaccgugcccaaggaggugcuggacuccuggacgggggcguucaacacccgccggcagccccucuucgcccacauccgccggcgcggcgagagccgggucuga

SEQ ID NO: 13050 - RNA, 807 nt, Artificial Sequence
  derived and/or modified sequence opt1 from capsid_protein_VP2__Norovirus__AFX81233
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggucaagcaggcgaugcugcuggagggcggguucuccgagaccgacgccgcccgcggcgccaucaacgcccccaugacgaaggugcucgacuggagcgggacccgguacugggcgccggacgcccgcaccaccacguacaacgccggccgguucuccacgccccagcccagcgggacccugcccggccgcaucaacccgcggacccccacccccgcccgcggcuccagcuccaccagcuccaacgugagcaccgccaccuccaucuacagcaaccagacguucuccacccggcuggggagcaccgcgggcagcgggaccaacgucuccagccuccccuccacggcccgcacccggagcuggguggaggaccagaaccgcaaccuguccccguucaugcggggcgcccacaacaucagcuucgugaccccgcccuccagccgcuccagcucccagggcaccgucagcacggugcccaaggaggugcuggacuccuggaccggggccuucaacacccggcgccagccccucuucgcccacauccggcgccggggcgagagccgcgucuga

SEQ ID NO: 13051 - RNA, 807 nt, Artificial Sequence
  derived and/or modified sequence opt1 from capsid_protein_VP2__Norovirus__AFX81239
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgugagcaccgccaccuccaucuacagcaaccagacggcguccacccgccuggggagcaccgccggcagcgggaccaacgucuccagccuccccuccacggcccggacccgcagcuggguggaggaccagaaccggaaccuguccccguucaugcgcggcgcccacaacaucagcuucgugaccccgcccuccagccgguccagcucccagggcaccgucagcacggugcccaaggaggugcuggacuccuggaccggggccuucaacacccgccggcagccccucuucgcgcacauccgccggcgcggcgagagccgggucuga

SEQ ID NO: 13052 - RNA, 807 nt, Artificial Sequence
  derived and/or modified sequence opt1 from capsid_protein_VP2__Norovirus__AFX81242
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggaccgggacccgguacugggcgccggacgcccgcacgaccaccuacaacgccggccgguucagcacgccccagcccuccggggcccugcccggccgcgccaaccugcgggcgaccgugccggcccgcggcagcuccagcaccuucuccaacagcuccaucgccaccagcgucuacuccaaccagaccacgagcacccggcucggguccaccgccggcagcgggaccagcguguccagccugcccuccacggcccgcacccggagcuggguggaggaccagaaccgcaaccugucccccuucaugcggggcgcgcacaacaucagcuucgucacgcccccguccagccgcuccagcucccagggcaccgugagcaccgugcccaaggagguccucgacuccuggaccggggccuucaacacccggcgccagccccuguucgcccacauccggaagcgcggcgagagccggguguga

SEQ ID NO: 13053 - RNA, 807 nt, Artificial Sequence
  derived and/or modified sequence opt1 from capsid_protein_VP2__Norovirus__AFX81245
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccagccugcagcaggccuccuuccagcacgacaaggagaugcugcaggcccagaucgaggccaccaagaagcuccagcaggagaugaugcgggugaagcaggcgaugcugcuggagggcggguucagcgagaccgacgccgcccgcggcgccaucaacgcccccaugacgaagacccucgacugguccgggacccgguacugggcgccggacgcccgcaccacgaccuacaacgccggccgguucagcacgccccagcccuccggggcccugcccggccgcgccaaccugcgggcgaccgugccggcccgcggcagcuccagcaccuccagcaacuccagcaucgccaccuccgucuacagcaaccagaccaccagcacgcggcucggguccaccgccggcagcgggaccuccgugagcucccugcccagcaccgcccgcacgcgguccuggguggaggaccagaaccgcaaccugagccccuucaugcggggcgcgcacaacaucuccuucgucacgcccccgagcucccgcagcuccagccagggcaccguguccaccgugcccaaggagguccucgacagcuggaccggggccuucaacacccggcgccagccccuguucgcccacauccggaagcgcggcgagucccggguguga

SEQ ID NO: 13054 - RNA, 807 nt, Artificial Sequence
  derived and/or modified sequence opt1 from capsid_protein_VP2__Norovirus__AFX81248
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccacccggaagcuccagcaggagaugaugcgcgugaagcaggcgaugcugcuggagggcggguucuccgagaccgacgccgcccggggcgccaucaacgcccccaugacgaagacccucgacuggagcgggacccgcuacugggcgccggacgcccggaccacgaccuacaacgccggccgcuucuccacgccccagcccagcggggcccugcccggccgggccaaccugcgcgcgaccgugccggcccggggcuccagcuccaccuucagcaacuccagcaucgccaccuccgucuacagcaaccagaccaccuccacgcgccucgggagcaccgccggcagcgggaccuccgugagcucccugcccagcaccgcccggacgcgcuccuggguggaggaccagaaccggaaccugagccccuucaugcgcggcgcgcacaacaucuccuucgucacgcccccgagcucccggagcuccagccagggcaccguguccaccgugcccaaggagguccucgacagcuggaccggggccuucaacacccgccggcagccccuguucgcccacauccgcaagcggggcgagucccgcguguga

SEQ ID NO: 13055 - RNA, 807 nt, Artificial Sequence
  derived and/or modified sequence opt1 from capsid_protein_VP2__Norovirus__AFX81251
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggagcgggacccgguacugggcgccggacgcccgcaccacgaccuacaacgccggccgguucuccacgccccagcccagcggggcccugcccggccgcgccaaccugcgggcgaccgugccggcccgcggcuccagcuccaccuucagcaacuccagcaucgccaccuccgucuacagcaaccagaccaccuccacgcggcucgggagcaccgccggcagcggggccuccgugagcucccugcccagcaccgcgcgcacccgguccuggguggaggaccagaaccgcaaccugagccccuucaugcggggcgcccacaacaucuccuucgucacgcccccgagcucccgcagcuccagccagggcaccguguccaccgugcccaaggagguccucgacagcuggaccggggccuucaacacgcggcgccagccccuguucgcccacauccggaagcgcggcgagucccggguguga

SEQ ID NO: 13056 - RNA, 807 nt, Artificial Sequence
  derived and/or modified sequence opt1 from capsid_protein_VP2__Norovirus__AFX81254
auggccggcgccuucuucgcggggcuggccagcgacgugcucggcuccgggcugggcagccugaucaacgccggggccggcgccaucaaccagaccgucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagacggacgccgcccgcggcgccaucaacgcccccaugaccaagacccucgacuggaccgggacgcgguacugggcgccggacgcccgcaccaccaccuacaacgccggccgguucagcacgccccagcccuccggggcccugcccggccgcgccaaccugcgggcgaccgugccggcccgcggcagcuccagcaccuucuccaacagcuccaucgccaccagcgucuacuccaaccagacgaccagcacccggcucggguccaccgccggcagcgggacgagcguguccagccugcccuccaccgcccgcacccggagcuggguggaggaccagaaccgcaaccugucccccuucaugcggggcgcgcacaacaucagcuucgucacgcccccguccagccgcuccagcucccagggcaccgugagcaccgugcccaaggagguccucgacuccuggaccggggccuucaacacccggcgccagccccuguucgcccacauccggaagcgcggcgagagccggguguga

SEQ ID NO: 13057 - RNA, 807 nt, Artificial Sequence
  derived and/or modified sequence opt1 from capsid_protein_VP2__Norovirus__AFX81257
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccagccugcagcaggccuccuuccagcacgacaaggagaugcugcaggcccagaucgaggccaccaagaagcuccagcaggagaugaugcgggugaagcaggcgaugcugcuggagggcggguucagcgagaccgacgccgcccgcggcgccaucaacgcccccaugacgaagacccucgacugguccgggacccgguacugggcgccggacgcccgcaccacgaccuacaacgccggccgguucagcacgccccagcccuccggggcccugcccggccgcgccaaccugcgggcgaccgugccggcccgcggcagcuccagcaccuccagcaacuccagcaucgccaccuccgucuacagcaaccagaccaccagcacgcggcucggguccaccgccggcagcgggaccuccgugagcucccaccccagcaccgcccgcacgcgguccuggguggaggaccagaaccgcaaccugagccccuucaugcggggcgcgcacaacaucuccuucgucacgcccccgagcucccgcagcuccagccagggcaccguguccaccgugcccaaggagguccuggacagcuggaccggggccuucaacacccggcgccagccccucuucgcccacauccggaagcgcggcgagucccggguguga

SEQ ID NO: 13058 - RNA, 807 nt, Artificial Sequence
  derived and/or modified sequence opt1 from capsid_protein_VP2__Norovirus__AFX81260
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccacagcaaccagacgguguccacccgccuggggagcaccgccggcagcgggaccaacgucuccagccuccccuccacggcccggacccgcagcuggguggaggaccagaaccggaaccuguccccguucaugcgcggcgcccacaacaucagcuucgugaccccgcccuccagccgguccagcucccagggcaccgucagcacggugcccaaggaggugcuggacuccuggaccggggccuucaacacccgccggcagccccucuucgcgcacacccgccggcgcggcgagagccgggucuga

SEQ ID NO: 13059 - RNA, 807 nt, Artificial Sequence; identical to SEQ ID NO: 13030
  derived and/or modified sequence opt1 from capsid_protein_VP2__Norovirus__AFX81263

SEQ ID NO: 13060 - RNA, 807 nt, Artificial Sequence; identical to SEQ ID NO: 13030
  derived and/or modified sequence opt1 from capsid_protein_VP2__Norovirus__AFX81269

SEQ ID NO: 13061 - RNA, 807 nt, Artificial Sequence; identical to SEQ ID NO: 13022
  derived and/or modified sequence opt1 from capsid_protein_VP2__Norovirus__AFX81272

SEQ ID NO: 13062 - RNA, 807 nt, Artificial Sequence; identical to SEQ ID NO: 13030
  derived and/or modified sequence opt1 from capsid_protein_VP2__Norovirus__AFX81275

SEQ ID NO: 13063 - RNA, 807 nt, Artificial Sequence; identical to SEQ ID NO: 13030
  derived and/or modified sequence opt1 from capsid_protein_VP2__Norovirus__AFX81278

SEQ ID NO: 13064 - RNA, 807 nt, Artificial Sequence
  derived and/or modified sequence opt1 from capsid_protein_VP2__Norovirus__AFX81281
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcggggcccugcccggccggaucaacccgcgcacccccacccccgcccggggcuccagcuccaccagcuccaacgcgagcaccgccaccuccauccacagcaaccagaccguguccacgcgccuggggagcaccgccggcagcgggaccaacgucuccagccuccccuccaccgcccggacgcgcagcuggguggaggaccagaaccggaaccuguccccguucaugcgcggcgcccacaacaucagcuucgugaccccgcccuccagccgguccagcucccagggcaccgucagcaccgugcccaaggaggugcuggacuccuggacgggggcguucaacacccgccggcagccccucuucgcccacauccgccggcgcggcgagagccgggucuga

SEQ ID NO: 13065 - RNA, 807 nt, Artificial Sequence; identical to SEQ ID NO: 13030
  derived and/or modified sequence opt1 from capsid_protein_VP2__Norovirus__AFX81284

SEQ ID NO: 13066 - RNA, 807 nt, Artificial Sequence
  derived and/or modified sequence opt1 from capsid_protein_VP2__Norovirus__AFX81287
auggccggcgccuucuucgcggggcuggccagcgacgugcucggcuccgggcugagcucccugaucaacgccggcgccggggccaucaaccagaagaucgacuucgagaacaaccgcaagcuccagcaggcgagcuuccaguucuccagcaaccugcagcaggccuccuuccagcacgacaaggagaugcugcaggcccagaucgaggccaccaagaagcuccagcaggagaugaugaaggucaagcaggcgaugcugcuggagggcggcuucagcgagaccgacgccgcccgcggggccaucaacgcccccaugacgaaggugcucgacugguccggcacccgguacugggcgccggacgcccggaccaccacguacaacgccgggcgcuucagcacgccccagcccuccggcacccugcccgggcggaucaacccgcgcacccccacccccgcccggggcagcuccagcaccuccagcaacgcccccaccgcgaccuccauccacagcaaccagacgguguccacccgccugggcagcaccgccgggagcggcaccaacgucuccagccucccguccacggcccggacccgcagcuggguggaggaccagaaccggaaccugucccccuucaugcgcggggcccacaacaucagcuucgugaccccgcccuccagccgguccagcucccagggcaccgucagcacggugcccaaggaggugcuggacuccuggaccggcgccuucaacacccgccggcagccccucuucgcgcacauccgccggcgcggggagagccgggucuga

SEQ ID NO: 13067 - RNA, 807 nt, Artificial Sequence; identical to SEQ ID NO: 13030
  derived and/or modified sequence opt1 from capsid_protein_VP2__Norovirus__AFX81290

SEQ ID NO: 13068 - RNA, 807 nt, Artificial Sequence; identical to SEQ ID NO: 13022
  derived and/or modified sequence opt1 from capsid_protein_VP2__Norovirus__AFX81293

SEQ ID NO: 13069 - RNA, 807 nt, Artificial Sequence
  derived and/or modified sequence opt1 from capsid_protein_VP2__Norovirus__AFX81296
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccgggugaacccgcgcacccccacccccgcccggggcuccagcuccaccagcuccaacgccagcaccgcgaccuccauccacagcaaccagacggucuccacccgccuggggagcaccgccggcagcgggaccaacguguccagccuccccuccacggcccggacccgcagcuggguggaggaccagaaccggaaccuguccccguucaugcgcggcgcccacaacaucagcuucgucaccccgcccuccagccgguccagcucccagggcaccgugagcacggugcccaaggagguccuggacuccuggaccggggccuucaacacccgccggcagccccucuucgcgcacauccgccggcgcggcgagagccggguguga

SEQ ID NO: 13070 - RNA, 807 nt, Artificial Sequence
  derived and/or modified sequence opt1 from capsid_protein_VP2__Norovirus__AFX81299
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacuggaccccggacgcgcggaccacgaccuacaacgccggccgcuucuccacgccccagcccagcgggacccugcccggccggaucaacccgcgcacccccacccccgcccggggcuccagcuccaccagcuccaacgccagcaccgccacguccauccacagcaaccagaccguguccacccgccuggggagcaccgcgggcagcgggacgaacgucuccagccuccccuccaccgcccggacccgcagcuggguggaggaccagaaccggaaccuguccccguucaugcgcggcgcccacaacaucagcuucgugaccccgcccuccagccgguccagcucccagggcacggucagcaccgugcccaaggaggugcuggacuccuggaccggggccuucaacacccgccggcagccccucuucgcccacauccgccggcgcggcgagagccgggucuga

SEQ ID NO: 13071 - RNA, 807 nt, Artificial Sequence
  derived and/or modified sequence opt1 from capsid_protein_VP2__Norovirus__AFX81302
auggccggcgccuucuucgcggggcuggccagcgacgugcucuccagcggccuggggucccugaucaacgccggcgccggggccaucaaccagaagaucgacuucgagaacaaccgcaagcuccagcaggcgagcuuccaguucuccagcaaccugcagcaggccuccuuccagcacgacaaggagaugcugcaggcccagaucgaggccaccaagaagcuccagcaggagaugaugaaggucaagcaggcgaugcugcuggagggcggcuucagcgagaccgacgccgcccgcggggccaucaacgcccccaugacgaaggcgcucgacugguccggcacccgguacugggccccggacgcccggaccaccacguacagcgccgggcgcuucuccacgccccagcccagcggcgcccugcccgggcggaccaacccgcgcgcgcccauccccgcccggggcucccccagcaccuccagcggcgccuccaccgccaccagcaucuacuccaaccagaccgugagcacccgccuggggagcacggccggcuccgggaccaacgugagcucccucccgagcaccgcgcggacccgcuccugggucgaggaccagaaccggaaccugagccccuucaugcgcggcgcccacaacaucuccuucgugacgccgcccagcucccggagcuccagccagggcaccguguccaccguccccaaggaggugcuggacagcuggaccggggccuucaacacgcgccggcagccccucuucgcccacauccgccggcgcggcgagucccggguguga

SEQ ID NO: 13072 - RNA, 807 nt, Artificial Sequence
  derived and/or modified sequence opt1 from capsid_protein_VP2__Norovirus__AFX81305
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccgaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacuccgccggccgcuucagcacgccccagcccuccgggacccugcccggccggaccaacccgcgcacccccacccccgcccggggcagcuccagcaccuccagcaacgccuccaccgcgacgagcauccacuccaaccagaccgugagcacccgccuggggagcaccgccggcuccgggacgaacgucagcucccuccccagcaccgcccggacccgcuccuggguggaggaccagaaccggaaccugagcccguucaugcgcggcgcccacaacaucuccuucgugaccccgcccagcucccggagcuccagccagggcacggucuccaccgugcccaaggaggugcuggacagcuggaccggggccuucaacacccgccggcagccccucuucgcgcacauccgccggcgcggcgagucccgggucuga

SEQ ID NO: 13073 - RNA, 807 nt, Artificial Sequence; identical to SEQ ID NO: 13022
  derived and/or modified sequence opt1 from capsid_protein_VP2__Norovirus__AFX81308

SEQ ID NO: 13074 - RNA, 807 nt, Artificial Sequence; identical to SEQ ID NO: 13030
  derived and/or modified sequence opt1 from capsid_protein_VP2__Norovirus__AFX81311

SEQ ID NO: 13075 - RNA, 807 nt, Artificial Sequence; identical to SEQ ID NO: 13022
  derived and/or modified sequence opt1 from capsid_protein_VP2__Norovirus__AFX81314

SEQ ID NO: 13076 - RNA, 807 nt, Artificial Sequence; identical to SEQ ID NO: 13022
  derived and/or modified sequence opt1 from capsid_protein_VP2__Norovirus__AFX81317

SEQ ID NO: 13077 - RNA, 807 nt, Artificial Sequence; identical to SEQ ID NO: 13022
  derived and/or modified sequence opt1 from capsid_protein_VP2__Norovirus__AFX81320

SEQ ID NO: 13078 - RNA, 807 nt, Artificial Sequence
  derived and/or modified sequence opt1 from capsid_protein_VP2__Norovirus__AFX81323
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacuccgccggccgcuucagcacgccccagcccuccgggacccugcccggccggaucaacccgcgcacccccacccccgcccggggcagcuccagcaccuccagcaacgccuccaccgcgaccagcauccacuccaaccagacggugagcacccgccuggggagcaccgccggcuccgggaccaacgucagcucccuccccagcacggcccggacccgcuccuggguggaggaccagaaccggaaccugagcccguucaugcgcggcgcccacaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13079 - RNA, 807 nt, Artificial Sequence; identical to SEQ ID NO: 13030
  derived and/or modified sequence opt1 from capsid_protein_VP2__Norovirus__AFX81326

SEQ ID NO: 13080 - RNA, 807 nt, Artificial Sequence; identical to SEQ ID NO: 13022
  derived and/or modified sequence opt1 from capsid_protein_VP2__Norovirus__AGE89434

SEQ ID NO: 13081 - RNA, 807 nt, Artificial Sequence; identical to SEQ ID NO: 13022
  derived and/or modified sequence opt1 from capsid_protein_VP2__Norovirus__AGE89437

SEQ ID NO: 13082 - RNA, 807 nt, Artificial Sequence
  derived and/or modified sequence opt1 from capsid_protein_VP2__Norovirus__AGE89440
auggccggcgccuucuucgcggggcuggccagcgacgugcucggcuccgggcugggcagccugaucuccgccggggccggcgccaucaaccagaaggucgaguucgagaacaaccgcaagcuccagcaggcgagcuuccaguucuccagcaaccugcagcaggccuccuuccagcacgacaaggagaugcugcaggcccagaucgaggccaccaagaagcuccagcaggagaugaugcgggugaagcaggcgaugcugcuggagggcggguucagcgagaccgacgccgcccgcggcgccaucaacgcccccaugacgaagacccucgacugguccgggacccgguacugggcgccggacgcccgcaccacgaccuacaacgccggccgguucagcacgccccagcccuccggggcccugcccggccgcgccaaccugcgggcgaccgugccggcccgcggcagcuccagcaccuucuccaacagcuccaucgccaccagcgucuacuccaaccagaccaccagcacgcggcucgggagcaccgccggcuccgggaccagcguguccagccugcccuccaccgcccgcacgcggagcuggguggaggaccagaaccgcaaccugucccccuucaugcggggcgcgcacaacaucagcuucgucacgcccccguccagccgcuccagcucccagggcaccgugagcaccgugcccaaggagguccucgacuccuggaccggggccuucaacacccggcgccagccccuguucgcccacauccggaagcgcggcgagagccggguguga

SEQ ID NO: 13083 - RNA, 807 nt, Artificial Sequence
  derived and/or modified sequence opt1 from capsid_protein_VP2__Norovirus__AGE89443
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggagcgggacccgguacugggcgccggacgcccgcaccacgaccuacaacgccggccgguucuccacgccccagcccagcggggcccugcccggccgcgccaaccugcgggcgaccgugccggcccgcggcuccagcuccaccagcuccaacgccagcaucgccaccuccgucuacagcaaccagaccaccuccacgcggcucgggagcaccgccggcagcgggaccuccgugagcucccugcccagcaccgcgcgcacgcgguccuggguggaggaccagaaccgcaaccugagccccuucaugcggggcgcccacaacaucuccuucgucacgcccccgagcucccgcagcuccagccagggcaccguguccaccgugcccaaggagguccucgacagcuggaccggggccuucaacacccggcgccagccccuguucgcccacauccggaagcgcggcgagucccggguguga

SEQ ID NO: 13084 - RNA, 807 nt, Artificial Sequence
  derived and/or modified sequence opt1 from capsid_protein_VP2__Norovirus__AGE89449
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggagcgggacccgguacugggcgccggacgcccgcaccacgaccuacaacgccggccgguucuccacgccccagcccagcggggugcugcccggccgcgccaaccugcgggccaccgucccggcgcgcggcuccagcuccaccuucagcaacuccagcaucgccaccuccguguacagcaaccagaccaccuccacgcggcucgggagcaccgccggcagcgggaccuccgugagcucccugcccagcaccgcccgcacgcgguccugggucgaggaccagaaccgcaaccugagccccuucaugcggggcgcccacaacaucuccuucgugacgcccccgagcucccgcagcuccagccagggcaccguguccaccguccccaaggaggugcucgacagcuggaccggggcguucaacacccggcgccagccccuguucgcccacauccggaagcgcggcgagucccggguguga

SEQ ID NO: 13085 - RNA, 807 nt, Artificial Sequence; identical to SEQ ID NO: 13064
  derived and/or modified sequence opt1 from capsid_protein_VP2__Norovirus__AGE89455

SEQ ID NO: 13086 - RNA, 807 nt, Artificial Sequence; identical to SEQ ID NO: 13022
  derived and/or modified sequence opt1 from capsid_protein_VP2__Norovirus__AGE89458

SEQ ID NO: 13087 - RNA, 807 nt, Artificial Sequence; identical to SEQ ID NO: 13030
  derived and/or modified sequence opt1 from capsid_protein_VP2__Norovirus__AGE89461

SEQ ID NO: 13088 - RNA, 807 nt, Artificial Sequence
  derived and/or modified sequence opt1 from capsid_protein_VP2__Norovirus__AGE89464
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccacccccagcaacgccuccaccgcgaccagcauccacuccaaccagacggugagcacccgccugggguccaccgccggcagcgggaccaacgucagcucccucccgagcacggcccggacccgcuccuggguggaggaccagaaccggaaccugagccccuucaugcgcggcgcccacaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13089 - RNA, 807 nt, Artificial Sequence; identical to SEQ ID NO: 13022
  derived and/or modified sequence opt1 from capsid_protein_VP2__Norovirus__AGE89467

SEQ ID NO: 13090 - RNA, 807 nt, Artificial Sequence
  derived and/or modified sequence opt1 from capsid_protein_VP2__Norovirus__AGE89470
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccgggccaccaccuacaacgccggccgcuucuccacgccccagcccagcgggacccugcccggccggaucaacccgcgcacccccacccccgcccggggcucccccagcacguccagcaacgcguccaccgccaccagcaucuacuccaaccagaccgugagcacgcgccugggguccaccgccggcagcgggaccaacgucagcucccucccgagcaccgcccggacgcgcuccuggguggaggaccagaaccggaaccugagccccuucaugcgcggcgcccacaacaucuccuucgugaccccgcccagcucccggagcuccagccagggcaccgucuccaccgugcccaaggaggugcuggacagcuggacgggggcguucaacacccgccggcagccccucuucgcccacauccgccggcgcggcgagucccgggucuga

SEQ ID NO: 13091 - RNA, 807 nt, Artificial Sequence
  derived and/or modified sequence opt1 from capsid_protein_VP2__Norovirus__AGE89473
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcggggcccugcccggccggaucaacccgcgcacccccacccccgcccggggcuccagcuccaccagcuccaacgcgagcaucgccaccuccauccacagcaaccagaccguguccacccgccuggggagcacggccggcagcgggaccaacgucuccagccuccccuccaccgcccggacccgcagcuggguggaggaccagaaccggaaccuguccccguucaugcgcggcgcccacaacaucagcuucgugacgccgcccuccagccgguccagcucccagggcaccgucagcaccgugcccaaggaggugcuggacuccuggaccggggcguucaacacgcgccggcagccccucuucgcccacauccgccggcgcggcgagagccgggucuga

SEQ ID NO: 13092 - RNA, 807 nt, Artificial Sequence
  derived and/or modified sequence opt1 from capsid_protein_VP2__Norovirus__AGE89476
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuucaacgccuccaccgcgaccagcauccacuccaaccagacggugagcacccgccugggguccaccgccggcagcgggaccaacgucagcucccuccccagcacggcccggacccgcuccuggguggaggaccagaaccggaaccugagcccguucaugcgcggcgcccacaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13093 - RNA, 807 nt, Artificial Sequence
  derived and/or modified sequence opt1 from capsid_protein_VP2__Norovirus__AGE89479
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagagcuccgggacccugcccggccggaucaacccccgcaccccgacccccgcccggggcagcuccagcaccuccagcaacgccuccaccgcgaccagcauccacuccaaccagacggugagcacccgccuggggagcaccgccggcuccgggaccaacgucagcucccaccccagcacggcccggacccgcuccuggguggaggaccagaaccggaaccucagccccuucaugcgcggcgcccacaacaucuccuucgugaccccgcccagcucccggagcuccagccagggcaccgucuccacggugcccaaggaggugcuggacagcuggaccggggccuucaacacccgccggcagccccuguucgcgcacauccgccggcgcggcgagucccgggucuga

SEQ ID NO: 13094 - RNA, 807 nt, Artificial Sequence; identical to SEQ ID NO: 13030
  derived and/or modified sequence opt1 from capsid_protein_VP2__Norovirus__AGE89482

SEQ ID NO: 13095 - RNA, 807 nt, Artificial Sequence
  derived and/or modified sequence opt1 from capsid_protein_VP2__Norovirus__AGE89485
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccacagcaaccagacgguguccacccgccuggggagcaccgccggcagcgggaccaacgucuccagccuccccuccacggcccggacccgcagcuggguggaggaccagaaccggaaccuguccccguucaugcgcggcgcccggaacaucagcuucgugaccccgcccuccagccgcuccagcucccagggcaccgucagcacggugcccaaggaggugcuggacuccuggaccggggccuucaacacccggcgccagccccucuucgcgcacauccggcgccggggcgagagccgcgucuga

SEQ ID NO: 13096 - RNA, 807 nt, Artificial Sequence
  derived and/or modified sequence opt1 from capsid_protein_VP2__Norovirus__AGE89488
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccgcgccccagcccagcgggucccugcccggccggaucaacccgcgcgcccccacccccgcccgggugagcuccagcaccuccagcaacgccuccaccgucacgagcaucuacuccaaccagaccgugagcacccgccugggcagcaccgccggguccggcacgaacgugagcucccuccccagcaccgcccggacccgcuccugggucgaggaccagaaccggaaccugagcccguucaugcgcggggcccacaacaucuccuucgugaccccgcccagcucccggagcuccagccagggcacgguguccaccguccccaaggaggugcuggacagcuggaccggcgcguucaacacccgccggcagccccucuucgcccacauccgccggcgcggggagucccggguguga

SEQ ID NO: 13097 - RNA, 807 nt, Artificial Sequence; identical to SEQ ID NO: 13022
  derived and/or modified sequence opt1 from capsid_protein_VP2__Norovirus__AGE89491

SEQ ID NO: 13098 - RNA, 807 nt, Artificial Sequence
  derived and/or modified sequence opt1 from capsid_protein_VP2__Norovirus__AGE89494
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaucaccuacaacgccggccgcuucuccacgccccagcccagcgggacccugcccggccggaucaacccgcgcgcccccacccccgcccggggcuccagcuccaccagcuccaacgcgagcacggccaccuccaucuacagcaaccagaccguguccacccgccuggggagcacggccggcagcgggaccaacgucuccagccuccccuccaccgcccggacccgcagcuggguggaggaccagaaccggaaccuguccccguucaugcgcggcgcccacaacaucagcuucgugacgccgcccuccagccgguccagcucccagggcaccgucagcaccgugcccaaggaggugcuggacuccuggaccggggcguucaacacgcgccggcagccccucuucgcccacauccgccggcgcggcgagagccgggucuga

SEQ ID NO: 13099 - RNA, 807 nt, Artificial Sequence
  derived and/or modified sequence opt1 from capsid_protein_VP2__Norovirus__AGE89497
auggccggcgccuucuucgcggggcuggccagcgacgugcucggcuccgggcugggcagccugaucuccgccggggccggcgccaucaaccagaagaucgacuucgagaacaaccgcaagcuccagcaggcgagcuuccaguucuccagcaaccugcagcaggccuccuuccagcacgacaaggagaugcugcaggcccagaucgaggccaccaagaagcuccagcaggagaugaugaaggucaagcaggcgaugcugcuggagggcggguucagcgagaccgacgccgcccggggcgccaucaacgcccccaugacgaaggugcucgacugguccgggacccgcuacugggcgccggacgcccggaccaccacguacaacgccggccgcuucagcacgccccagcccuccgggacccugcccggccggaucaacccgcgcacccccacccccgcccggggcagcuccagcaccuccagcaacgccuccaccgcgaccagcaucuacuccaaccagacggugagcacccgccuggggagcaccgccggcuccgggaccaacgucagcucccuccccagcacggcccggacccgcuccuggguggaggaccagaaccggaaccugagcccguucaugcgcggcgcccacaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13100 - RNA, 807 nt, Artificial Sequence; identical to SEQ ID NO: 13022
  derived and/or modified sequence opt1 from capsid_protein_VP2__Norovirus__AGE89500

SEQ ID NO: 13101 - RNA, 807 nt, Artificial Sequence; identical to SEQ ID NO: 13022
  derived and/or modified sequence opt1 from capsid_protein_VP2__Norovirus__AGE89503

SEQ ID NO: 13102 - RNA, 807 nt, Artificial Sequence
  derived and/or modified sequence opt1 from capsid_protein_VP2__Norovirus__AGE89506
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccaugcacagcaaccagacgguguccacccgccuggggagcaccgccggcagcgggaccaacgucuccagccuccccuccacggcccggacccgcagcuggguggaggaccagaaccggaaccuguccccguucaugcgcggcgcccacaacaucagcuucgugaccccgcccuccagccgguccagcucccagggcaccgucagcacggugcccaaggaggugcuggacuccuggaccggggccuucaacacccgccggcagccccucuucgcgcacauccgccggcgcggcgagagccgggucuga

SEQ ID NO: 13103 - RNA, 807 nt, Artificial Sequence
  derived and/or modified sequence opt1 from capsid_protein_VP2__Norovirus__AGE89509
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggucccugcccggccggaucaacccgcgcgcccccacccccgcccgggcgagcuccagcaucuccagcaacgccuccaccgugaccagcaucuacuccaaccagaccgucagcacccgccugggcagcaccgccggguccggcacgaacgugagcucccuccccagcaccgcccggacccgcuccuggguggaggaccagaaccggaaccugagcccguucaugcgcggggcccacaacaucuccuucgucaccccgcccagcucccggagcuccagccagggcacgguguccaccgugcccaaggagguccuggacagcuggaccggcgcguucaacacccgccggcagccccucuucgcccacauccgccggcgcggggagucccggguguga

SEQ ID NO: 13104 - RNA, 807 nt, Artificial Sequence; identical to SEQ ID NO: 13022
  derived and/or modified sequence opt1 from capsid_protein_VP2__Norovirus__AGE89512

SEQ ID NO: 13105 - RNA, 807 nt, Artificial Sequence; identical to SEQ ID NO: 13030
  derived and/or modified sequence opt1 from capsid_protein_VP2__Norovirus__AGE89515

SEQ ID NO: 13106 - RNA, 807 nt, Artificial Sequence
  derived and/or modified sequence opt1 from capsid_protein_VP2__Norovirus__AGE89518
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcagaccaugcugcuggagggcggguucuccgagacggacgcggcccggggcgccaucaacgcccccaugaccaaggugcucgacuggagcgggacccgcuacugggccccggacgcgcggaccacgaccuacaacgccggccgcuucuccacgccccagcccagcgggacccugcccggccggaucaacccgcgcacccccacccccgcccggggcuccagcuccaccagcuccaacgccagcaccgccacguccauccacagcaaccagaccguguccacccgccuggggagcaccgcgggcagcgggacgaacgucuccagccuccccuccaccgcccggacccgcagcuggguggaggaccagaaccggaaccuguccccguucaugcgcggcgcccacaacaucagcuucgugaccccgcccuccagccgguccagcucccagggcacggucagcaccgugcccaaggaggugcuggacuccuggaccggggccuucaacacccgccggcagccccucuucgcccacauccgccggcgcggcgagagccgggucuga

SEQ ID NO: 13107 - RNA, 807 nt, Artificial Sequence
  derived and/or modified sequence opt1 from capsid_protein_VP2__Norovirus__AGE89521
auggccggcgccuucuucgcggggcuggccagcgacgugcucggcuccgggcugggcagccugaucaacgccggggccggcgccaucaaccagaagaucgacuucgagaacaaccgcaagcuccagcaggucuccuuccaguucagcuccaaccugcagcaggcgagcuuccagcacgacaaggagaugcugcaggcccagaucgaggccaccaagaagcuccagcaggagaugaugaaggugaagcaggccaugcugcuggagggcggguucuccgagaccgacgcggcccggggcgccaucaacgcccccaugacgaaggugcucgacuggagcgggacccgcuacugggccccggacgcgcggaccaccacguacaacgccggccgcuucuccacgccccagcccagcgggacccugcccggccggaucaacccgcgcacccccacccccgcccggggcuccagcuccaccagcuccaacgccagcaccgccaccuccauccacagcaaccagacggucuccacccgccuggggagcaccgcgggcagcgggaccaacguguccagccuccccuccacggcccggacccgcagcuggguggaggaccagaaccggaaccuguccccguucaugcgcggcgcccacaacaucagcuucgucaccccgcccuccagccgguccagcucccagggcaccgugagcacggugcccaaggagguccuggacuccuggaccggggccuucaacacccgccggcagccccucuucgcccacauccgccggcgcggcgagagccggguguga

SEQ ID NO: 13108 - RNA, 807 nt, Artificial Sequence; identical to SEQ ID NO: 13022
  derived and/or modified sequence opt1 from capsid_protein_VP2__Norovirus__AGE89524

SEQ ID NO: 13109 - RNA, 807 nt, Artificial Sequence
  derived and/or modified sequence opt1 from capsid_protein_VP2__Norovirus__AGE89530
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaccaacccgcgcacccccacccccgcccggggcuccagcuccaccagcuccaacgccagcaccgcgacguccaucuacagcaaccagaccguguccacccgccuggggagcaccgccggcagcgggacgaacgucuccagccuccccuccaccgcccggacccgcagcuggguggaggaccagaaccggaaccuguccccguucaugcgcggcgcccacaacaucagcuucgugaccccgcccuccagccgguccagcucccagggcacggucagcaccgugcccaaggaggugcuggacuccuggaccggggccuucaacacccgccggcagccccucuucgcgcacauccgccggcgcggcgagagccgggucuga

SEQ ID NO: 13110 - RNA, 807 nt, Artificial Sequence
  derived and/or modified sequence opt1 from capsid_protein_VP2__Norovirus__AGE89533
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaucaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacuccgccggccgcuucagcacgccccagcccuccgggacccugcccggccggaucaacccgcgcacccccacccccgcccggggcagcuccagcaccuucuccaacgccagcaccgcgaccuccauccacagcaaccagacgguguccacccgccuggggagcaccgccggcagcgggaccaacgucuccagccuccccuccacggcccggacccgcagcuggguggaggaccagaaccggaaccuguccccguucaugcgcggcgcccacaacaucagcuucgugaccccgcccuccagccgguccagcucccagggcaccgucagcacggugcccaaggaggugcuggacuccuggaccggggccuucaacacccgccggcagccccucuucgcgcacauccgccggcgcggcgagagccgggucuga

SEQ ID NO: 13111 - RNA, 807 nt, Artificial Sequence; identical to SEQ ID NO: 13030
  derived and/or modified sequence opt1 from capsid_protein_VP2__Norovirus__AGE89536

SEQ ID NO: 13112 - RNA, 807 nt, Artificial Sequence; identical to SEQ ID NO: 13030
  derived and/or modified sequence opt1 from capsid_protein_VP2__Norovirus__AGE89539

SEQ ID NO: 13113 - RNA, 807 nt, Artificial Sequence; identical to SEQ ID NO: 13030
  derived and/or modified sequence opt1 from capsid_protein_VP2__Norovirus__AGE89542

SEQ ID NO: 13114 - RNA, 807 nt, Artificial Sequence; identical to SEQ ID NO: 13030
  derived and/or modified sequence opt1 from capsid_protein_VP2__Norovirus__AGE89545

SEQ ID NO: 13115 - RNA, 807 nt, Artificial Sequence
  derived and/or modified sequence opt1 from capsid_protein_VP2__Norovirus__AGE89548
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaucaccaccuacaacgccggccgcuucuccacgccccagcccagcgggacccugcccggccggaucaacccgcgcacccccacccccgcccggggcuccagcuccacgagcuccaacgccagcaccgcgaccuccauccacagcaaccagaccguguccacgcgccuggggagcaccgccggcagcgggaccaacgucuccagccuccccuccaccgcccggacgcgcagcuggguggaggaccagaaccggaaccuguccccguucaugcgcggcgcccacaacaucagcuucgugaccccgcccuccagccgguccagcucccagggcaccgucagcaccgugcccaaggaggugcuggacuccuggacgggggccuucaacacccgccggcagccccucuucgcgcacauccgccggcgcggcgagagccgggucuga

SEQ ID NO: 13116 - RNA, 807 nt, Artificial Sequence; identical to SEQ ID NO: 13022
  derived and/or modified sequence opt1 from capsid_protein_VP2__Norovirus__AGE89551

SEQ ID NO: 13117 - RNA, 807 nt, Artificial Sequence
  derived and/or modified sequence opt1 from capsid_protein_VP2__Norovirus__AGE89554
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccgcgccccagcccagcgggucccugcccggccggaucaacccgcgcgcccccacccccgcccgggugagcuccagcaccuccagcaacgccuccaccgucacgagcaucuacuccaaccagaccgugagcacccgccugggcagcaccgccggguccggcacgaacgugagcucccuccccagcaccgcccggacccgcuccugggucgaggaccagaaccggaaccugagcccguucaugcgcggggcccacaacaucuccuucgugaccccgcccagcucccggagcuccagccagggcacgguguccaccguccccaaggaggugcuggacagcuggaccggcgcguucaacacccgccggcagccccucuucgcccacgugcgccggcgcggggagucccgggucuga

SEQ ID NO: 13118 - RNA, 807 nt, Artificial Sequence; identical to SEQ ID NO: 13030
  derived and/or modified sequence opt1 from capsid_protein_VP2__Norovirus__AGE89557

SEQ ID NO: 13119 - RNA, 807 nt, Artificial Sequence
  derived and/or modified sequence opt1 from capsid_protein_VP2__Norovirus__AGE89560
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacucccgcaccccgacccccgcccggggcagcuccagcaccuccagcaacgccuccaccgcgaccagcaucuacuccaaccagacggugagcacccgccuggggagcaccgccggcuccgggaccaacgucagcucccuccccagcacggcccggacccgcuccuggguggaggaccagaaccggaaccugagccccuucaugcgcggcgcccacaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13120 - RNA, 807 nt, Artificial Sequence
  derived and/or modified sequence opt1 from capsid_protein_VP2__Norovirus__AGE89563
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggaugcugcccggccggaucaacccgcgcacccccacccccgcccggggcuccagcuccaccagcuccaacgccagcaccgcgaccuccauccacagcaaccagaccguguccacgcgccuggggagcaccgccggcagcgggaccaacgucuccagccuccccuccaccgcccggacgcgcagcuggguggaggaccagaaccggaaccuguccccguucaugcgcggcgcccacaacaucagcuucgugaccccgcccuccagccgguccagcucccagggcaccgucagcaccgugcccaaggaggugcuggacuccuggacgggggccuucaacacccgccggcagccccucuucgcgcacauccgccggcgcggcgagagccgggucuga

SEQ ID NO: 13121 - RNA, 807 nt, Artificial Sequence
  derived and/or modified sequence opt1 from capsid_protein_VP2__Norovirus__AGE89566
auggccggcgccuucuucgcggggcuggccagcgacgugcucuccagcggccuggggucccugaucaacgccggcgccggggccaucaaccagaagaucgacuucgagaacaaccgcaagcuccagcaggcgagcuuccaguucuccagcaaccugcagcaggccuccuuccagcacgacaaggagaugcugcaggcccagaucgaggccaccaagaagcuccagcaggagaugaugaaggucaagcaggcgaugcugcuggagggcggcuucagcgagaccgacgccgcccgcggggccaucaacgcccccaugacgaaggugcucgacugguccggcacccgguacugggcgccggacgcccggaccaccacguacaacgccgggcgcuucagcacgccccagcccuccggcacccugcccgggcggaucaacccgcgcauccccacccccgcccggggcagcuccagcaccuccagcaacgccuccaccgcgaccagcaucuacuccaaccagaccgugagcacgcgccugggcagcaccgccggguccggcaccaacgucagcucccuccccagcaccgcccggacgcgcuccuggguggaggaccagaaccggaaccugagcccguucaugcgcggggcccacaacaucuccuucgugaccccgcccagcucccggagcuccagccagggcaccgucuccaccgugcccaaggaggugcuggacagcuggacgggcgccuucaacacccgccggcagccccucuucgcgcacauccgccggcgcggggagucccgggucuga

SEQ ID NO: 13122 - RNA, 807 nt, Artificial Sequence; identical to SEQ ID NO: 13030
  derived and/or modified sequence opt1 from capsid_protein_VP2__Norovirus__AGE89569

SEQ ID NO: 13123 - RNA, 807 nt, Artificial Sequence; identical to SEQ ID NO: 13030
  derived and/or modified sequence opt1 from capsid_protein_VP2__Norovirus__AGE89572

SEQ ID NO: 13124 - RNA, 807 nt, Artificial Sequence
  derived and/or modified sequence opt1 from capsid_protein_VP2__Norovirus__AGE89578
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcuggagcgggugaacccccgcaccccgacccccgcccggggcuccagcuccaccagcuccaacgccagcaccgcgaccuccauccacagcaaccagacggucuccacccgccucggcagcaccgccgggagcggcaccaacguguccagccugcccuccacggcccggacccgcagcuggguggaggaccagaaccggaaccugucccccuucaugcgcggggcccacaacaucagcuucgucaccccgcccuccagccgguccagcucccagggcaccgugagcacggugcccaaggagguccucgacuccuggaccggcgccuucaacacccgccggcagccccuguucgcgcacauccgccggcgcggggagagccggguguga

SEQ ID NO: 13125 - RNA, 807 nt, Artificial Sequence
  derived and/or modified sequence opt1 from capsid_protein_VP2__Norovirus__AGE89581
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggaggucaugaaggugaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccaucuacagcaaccagacggucuccacccgccuggggagcaccgccggcagcgggaccaacguguccagccuccccuccacggcccggacccgcagcuggguggaggaccagaaccggaaccuguccccguucaugcgcggcgcccacaacaucagcuucgucaccccgcccuccagccgguccagcucccagggcaccgugagcacggugcccaaggagguccuggacuccuggaccggggccuucaacacccgccggcagccccucuucgcgcacauccgccggcgcggcgagagccggguguga

SEQ ID NO: 13126 - RNA, 807 nt, Artificial Sequence; identical to SEQ ID NO: 13120
  derived and/or modified sequence opt1 from capsid_protein_VP2__Norovirus__AGE89587

SEQ ID NO: 13127 - RNA, 807 nt, Artificial Sequence
  derived and/or modified sequence opt1 from capsid_protein_VP2__Norovirus__AGE89590
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccgagcgggugaacccgcgcacccccacccccgcccggggcuccagcuccaccagcuccaacgccagcaccgcgaccuccauccacagcaaccagacggucuccacccgccugggcagcaccgccgggagcggcaccaacguguccagccuccccuccacggcccggacccgcagcuggguggaggaccagaaccggaaccuguccccguucaugcgcggggcccacaacaucagcuucgucaccccgcccuccagccgguccagcucccagggcaccgugagcacggugcccaaggagguccuggacuccuggaccggcgccuucaacacccgccggcagccccucuucgcgcacauccgccggcgcggggagagccggguguga

SEQ ID NO: 13128 - RNA, 807 nt, Artificial Sequence; identical to SEQ ID NO: 13022
  derived and/or modified sequence opt1 from capsid_protein_VP2__Norovirus__AGE89593

SEQ ID NO: 13129 - RNA, 807 nt, Artificial Sequence
  derived and/or modified sequence opt1 from capsid_protein_VP2__Norovirus__AGE89596
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggagcgggacccgguacugggcgccggacgcccgcaccacgaccuacaacgccggccgguucuccacgccccagcccagcggggcccugcccggccgcgccaaccugcgggcgaccgugccggcccgcggcuccagcuccaccagcuccaacagcuccaucgccaccagcgucuacuccaaccagaccaccagcacgcggcucgggagcaccgccggcuccgggaccagcguguccagccugcccuccaccgcccgcacgcggagcuggguggaggaccagaaccgcaaccugucccccuucaugcggggcgcgcacaacaucagcuucgucacgcccccguccagccgcuccagcucccagggcaccgugagcaccgugcccaaggagguccucgacuccuggaccggggccuucaacacccggcgccagccccuguucgcccacauccggaagcgcggcgagagccggguguga

SEQ ID NO: 13130 - RNA, 807 nt, Artificial Sequence
  derived and/or modified sequence opt1 from capsid_protein_VP2__Norovirus__AGE89599
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaccaacccgcgcacccccacccccgcccggggcuccagcuccaucagcuccaacgccagcaccgcgaccuccauccacagcaaccagacgguguccacccgccuggggagcaccgccggcagcgggaccaacgucuccagccuccccuccacggcccggacccgcagcuggguggaggaccagaaccggaaccuguccccguucaugcgcggcgcccacaacaucagcuucgugaccccgcccuccagccgguccagcucccagggcaccgucagcacggugcccaaggaggugcuggacuccuggaccggggccuucaacacccgccggcagccccucuucgcgcacauccgccggcgcggcgagagccgggucuga

SEQ ID NO: 13131 - RNA, 807 nt, Artificial Sequence
  derived and/or modified sequence opt1 from capsid_protein_VP2__Norovirus__AGE89602
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccacagcaaccagacggccuccacccgccuggggagcaccgccggcagcgggaccaacguguccagccuccccuccacggcccggacccgcagcugggucgaggaccagaaccggaaccuguccccguucaugcgcggcgcccacaacaucagcuucgugaccccgcccuccagccgguccagcucccagggcaccgugagcacgguccccaaggaggugcuggacuccuggaccggggcguucaacacccgccggcagccccucuucgcccacauccgccggcgcggcgagagccggguguga

SEQ ID NO: 13132 - RNA, 807 nt, Artificial Sequence
  derived and/or modified sequence opt1 from capsid_protein_VP2__Norovirus__AGE89605
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccacagcaaccagacgguguccacccgccuggggagcaccgccggcagcgggaccaacgucuccagccuccccuccacggcccggacccgcagcuggguggaggaccagaaccggucccugagcccguucaugcgcggcgcccacaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13133 - RNA, 807 nt, Artificial Sequence
  derived and/or modified sequence opt1 from capsid_protein_VP2__Norovirus__AGE89608
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccacagcaaccagacgguguccacccgccugggguacaccgccggcagcgggaccaacgucagcucccuccccagcacggcccggacccgcuccuggguggaggaccagaaccggagccuguccccguucaugcgcggcgcccacaacaucagcuucgugaccccgcccuccagccgguccagcucccagggcaccgucagcacggugcccaaggaggugcuggacuccuggaccggggccuucaacacccgccggcagccccucuucgcgcacauccgccggcgcggcgagagccgggucuga

SEQ ID NO: 13134 - RNA, 807 nt, Artificial Sequence
  derived and/or modified sequence opt1 from capsid_protein_VP2__Norovirus__AGE89611
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucagcgcccccaugacgaaggugcucgacugguccgggacccgcuacugggcgccggacgcccggaccaccacguacaacgccggccgcuucagcacgccccagcccuccgggacccugcccggccggaucaacccgcgcacccccacccccgcccggggcagcuccagcaccuccagcaacgcccccaccgcgaccuccaucuacagcaaccagacgguguccacccgccuggggagcaccgccggcagcgggaccaacgucuccagccucccguccacggcccggacccgcagcuggguggaggaccagaaccggaaccugucccccuucaugcgcggcgcccacaacaucagcuucgugaccccgcccuccagccgguccagcucccagggcaccgucagcacggugcccaaggaggugcuggacuccuggaccggggccuucaacacccgccggcagccccucuucgcgcacauccgccggcgcggcgagagccgggucuga

SEQ ID NO: 13135 - RNA, 807 nt, Artificial Sequence
  derived and/or modified sequence opt1 from capsid_protein_VP2__Norovirus__AGE89614
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgagacccugcccgggcggaucaacccgcgcacccccacccccgcccggggcuccagcuccaccagcuccaacgccagcaccgcgaccuccauccacagcaaccagacgguguccacccgccugggcagcaccgccgggagcggcaccaacgucuccagccuccccuccacggcccggacccgcagcuggguggaggaccagaaccggucccugagcccguucaugcgcggggcccacaacaucuccuucgugaccccgcccagcucccggagcuccagccagggcaccgucuccacggugcccaaggaggugcuggacagcuggaccggcgccuucaacacccgccggcagccccucuucgcgcacauccgccggcgcggggagucccgggucuga

SEQ ID NO: 13136 - RNA, 807 nt, Artificial Sequence; identical to SEQ ID NO: 13129
  derived and/or modified sequence opt1 from capsid_protein_VP2__Norovirus__AGE89617

SEQ ID NO: 13137 - RNA, 807 nt, Artificial Sequence; identical to SEQ ID NO: 13037
  derived and/or modified sequence opt1 from capsid_protein_VP2__Norovirus__AGE89620

SEQ ID NO: 13138 - RNA, 807 nt, Artificial Sequence
  derived and/or modified sequence opt1 from capsid_protein_VP2__Norovirus__AGE89623
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggagcgggacccgguacugggcgccggacgcccgcaccacgaccuacaacgccggccgguucuccacgccccagcccagcggggcccugcccggccgcgccaaccugcgggcgaccgugccggcccgcggcuccagcuccaccuucagcaacuccagcaucgccaccuccgucuacagcaaccagaccaccuccacgcggcucgggagcaccgccggcagcgggaccuccgugagcucccugcccagcaccgcccgcacgcgguccuggguggaggaccagaaccgcaaccugagccccuucaugcggggcgcgcacaacaucuccuacgucacgcccccgagcucccgcagcuccagccagggcaccguguccaccgugcccaaggagguccucgacagcuggaccggggccuucaacacccggcgccagccccuguucgcccacauccggaagcgcggcgagucccggguguga

SEQ ID NO: 13139 - RNA, 807 nt, Artificial Sequence
  derived and/or modified sequence opt1 from capsid_protein_VP2__Norovirus__AGE89626
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggagcgggacccgguacugggcgccggacgcccgcaccacgaccuacaacgccggccgguucuccacgccccagcccagcggggcccugcccggccgcgccaaccugcgggcgaccgugccggcccgcggcuccagcuccaccuucagcaacuccagcaucgccaccuccgucuacagcaaccagaccaccuccacgcggcucgggagcaccgccggcagcgggaccuccgugagcucccugcccagcaccgcccgcacgcgguccuggguggaggaccagaaccgcaaccugagccccuucaugcggggcgcgcacaacaucuccuucgucacgcccccgagcucccgcagcuccagccagggcaccguguccaccgugcccaaggagguccucgacagcuggaccggggccuucaacacccggcgccagccccuguucgcccacauccggaagcgcggcgagucccggguguga

SEQ ID NO: 13140 - RNA, 807 nt, Artificial Sequence
  derived and/or modified sequence opt1 from capsid_protein_VP2__Norovirus__AGE89629
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggagcgggacccgguacugggcgccggacgcccgcaccacgaccuacaacgccggccgguucuccacgccccagcccagcggggcccugcccggcggcgccaaccugcgcgcgaccgugccggcccggggguccagcuccaccuucagcaacuccagcaucgccaccuccgucuacagcaaccagaccaccuccacgcgccucggcagcaccgccgggagcggcaccuccgugagcucccugcccagcaccgcccggacgcgcuccuggguggaggaccagaaccggaaccugagccccuucaugcgcggcgcgcacaacaucuccuucgucacgcccccgagcucccggagcuccagccaggggaccguguccaccgugcccaaggagguccucgacagcuggaccggcgccuucaacacccgccggcagccccuguucgcccacauccgcaagcgcggggagucccggguguga

SEQ ID NO: 13141 - RNA, 807 nt, Artificial Sequence; identical to SEQ ID NO: 13022
  derived and/or modified sequence opt1 from capsid_protein_VP2__Norovirus__AGE89635

SEQ ID NO: 13142 - RNA, 807 nt, Artificial Sequence
  derived and/or modified sequence opt1 from capsid_protein_VP2__Norovirus__AGE89638
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgccagcaccgcgaccuccauccaccugaaccagacggugagcacccgccucggguccaccgccggcagcgggaccaacgucagcucccugcccagcacggcccggacccgcuccuggguggaggaccagaaccggaaccugagcccguucaugcgcggcgcccacaacaucuccuucgugaccccgcccagcucccggagcuccagccagggcaccgucuccacggugcccaaggaggugcucgacagcuggaccggggccuucaacacccgccggcagccccuguucgcgcacauccgccggcgcggcgagucccgggucuga

SEQ ID NO: 13143 - RNA, 807 nt, Artificial Sequence
  derived and/or modified sequence opt1 from capsid_protein_VP2__Norovirus__AGE89641
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaccagcuccaacgugagcaccgccaccuccaucuacagcaaccagacggucuccacccgccuggggagcaccgcgggcagcgggaccaacguguccagccuccccuccacggcccggacccgcagcuggguggaggaccagaaccggaaccuguccccguucaugcgcggcgcccacaacaucagcuucgucaccccgcccuccagccgguccagcucccagggcaccgugagcacggugcccaaggagguccuggacuccuggaccggggccuucaacacccgccggcagccccucuucgcccacauccgccggcgcggcgagagccggguguga

SEQ ID NO: 13144 - RNA, 807 nt, Artificial Sequence
  derived and/or modified sequence opt1 from capsid_protein_VP2__Norovirus__AGE89644
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcggggcccugcccggccggaucaacccgcgcacccccacccccgcccggggcuccagcuccaccagcuccaacgcgagcaccgccaccuccauccacagcaaccagaccguguccacgcgccuggggagcaccgccggcagcgggaccaacgucuccggccuccccagcaccgcccggacgcgcuccuggguggaggaccagaaccggaaccugagcccguucaugcgcggcgcccacaacaucuccuucgugaccccgcccagcucccggagcuccagccaggggaccgucuccaccgugcccaaggaggugcuggacagcuggacgggcgcguucaacacccgccggcagccccucuucgcccacauccgccggcgcggggagucccgggucuga

SEQ ID NO: 13145 - RNA, 807 nt, Artificial Sequence
  derived and/or modified sequence opt1 from capsid_protein_VP2__Norovirus__AGE89647
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccaucagcuccaacgccagcaccgcgaccuccauccacagcaaccagaccguguccacgcgccuggggagcaccgccggcagcgggaccaacgucuccagcuuccccuccaccgcccggacgcgcagcuggguggaggaccagaaccggaaccucuccccguucaugcgcggcgcccacaacaucagcuucgugaccccgcccuccagccgguccagcucccagggcaccgucagcaccgugcccaaggaggugcuggacuccuggacgggggccuucaacacccgccggcagccccuguucgcgcacauccgccggcgcggcgagagccgggucuga

SEQ ID NO: 13146 - RNA, 807 nt, Artificial Sequence; identical to SEQ ID NO: 13120
  derived and/or modified sequence opt1 from capsid_protein_VP2__Norovirus__AGE89650

SEQ ID NO: 13147 - RNA, 807 nt, Artificial Sequence
  derived and/or modified sequence opt1 from capsid_protein_VP2__Norovirus__AGE89653
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaaggcgcucgacuggagcgggacccgguacugggccccggacgcccgcaccaccacguacaacgccggccacuucuccacgccccagagcuccggggcccugcccggccgggcgaaccugcgcgccgccgugcccgcccggggcagcuccagcaccuccagcaacuccagcaccgccaccuccgucuacagcaaccagaccaucagcacccgccucggguccaccgcgggcagcgggacguccgugagcucccugccgagcaccgcccggacccgcuccuggguggaggaccagaaccggaaccugagccccuucaugcgcggcgcccacaacaucuccuucgucaccccgcccagcucccggcccagcucccagggcacggugagcaccgugcccaaggagguccucgacuccuggaccggggccuucaacacccgccggcagccccuguucgcccacauccgcaagcggggcgagagccgcgcguga

SEQ ID NO: 13148 - RNA, 807 nt, Artificial Sequence; identical to SEQ ID NO: 13030
  derived and/or modified sequence opt1 from capsid_protein_VP2__Norovirus__AGE89656

SEQ ID NO: 13149 - RNA, 807 nt, Artificial Sequence
  derived and/or modified sequence opt1 from capsid_protein_VP2__Norovirus__AGE89659
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcauccccacccccgcccggggcuccagcuccaccagcuccaacgccagcaccgcgaccuccaucuacagcaaccagaccguguccacgcgccuggggagcgccgccggcagcgggaccaacgucuccagccuccccuccaccgcccggacccgcagcuggguggaggaccagaaccggaaccuguccccguucaugcgcggcgcccacaacaucagcuucgugacgccgcccuccagccgguccagcucccagggcaccgucagcaccgugcccaaggaggugcuggacuccuggaccggggcguucaacacgcgccggcagccccucuucgcccacauccgccggcgcggcgagagccgggucuga

SEQ ID NO: 13150 - RNA, 807 nt, Artificial Sequence
  derived and/or modified sequence opt1 from capsid_protein_VP2__Norovirus__AGE89662
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcaacaccuccagcaacgccuccaccgcgaccagcauccacuccaaccagacggugagcacccgccugggguccaccgccggcagcgggaccaacgucagcucccuccccagcacggcccggacccgcuccuggguggaggaccagaaccggaaccugagcccguucaugcgcggcgcccacaacaucuccuucgugaccccgcccagcucccggagcuccagccagggcaccgucuccacggugcccaaggaggugcuggacagcuggaccggggccuucaacacccgccggcagccccucuucgcgcacauccgccggcgcggcgagucccgggucuga

SEQ ID NO: 13151 - RNA, 807 nt, Artificial Sequence; identical to SEQ ID NO: 13037
  derived and/or modified sequence opt1 from capsid_protein_VP2__Norovirus__AGE89665

SEQ ID NO: 13152 - RNA, 807 nt, Artificial Sequence; identical to SEQ ID NO: 13150
  derived and/or modified sequence opt1 from capsid_protein_VP2__Norovirus__AGE89668

SEQ ID NO: 13153 - RNA, 807 nt, Artificial Sequence
  derived and/or modified sequence opt1 from capsid_protein_VP2__Norovirus__AGE89671
auggccggcgccuucuucgcggggcuggccagcgacgugcucggcuccgggcugggcagccugaucaacgccggggccggcgccaucaaccagaagaucgacuucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucagcgcccccaugacgaaggugcucgacugguccgggacccgcuacugggcgccggacgcccggaccaccacguacaacagcggccgcuucuccacgccccagcccagcgggacccugcccggccggaucaacccgcgcacccccacccccgcccggggcuccagcuccaccagcuccaacgccagcaccgccaccuccauccaccugaaccagacggugagcacccgccucgggagcaccgcgggcuccgggaccaacgucagcucccugcccagcacggcccggacccgcuccuggguggaggaccagaaccggaaccugagcccguucaugcgcggcgcccacaacaucuccuucgugaccccgcccagcucccggagcuccagccagggcaccgucuccacggugcccaaggagauccucgacagcugggccggggccuucaacacccgccggcagccccuguucgcgcacauccgccggcgcggcgagucccggguguga

SEQ ID NO: 13154 - RNA, 807 nt, Artificial Sequence; identical to SEQ ID NO: 13150
  derived and/or modified sequence opt1 from capsid_protein_VP2__Norovirus__AGE89674

SEQ ID NO: 13155 - RNA, 807 nt, Artificial Sequence
  derived and/or modified sequence opt1 from capsid_protein_VP2__Norovirus__AGE99604
auggccggcgccuucuucgcggggcuggccagcgacgugcucuccagcggccuggggucccugaucaacgccggcgccggggccaucaaccagaagaucgacuucgagaacaaccgcaagcuccagcaggcgagcuuccaguucuccagcaaccugcagcaggccuccuuccagcacgacaaggagaugcugcaggcccagaucgaggccaccaagaagcuccagcaggagcugaugaaggucaagcagaccauccugcucgagggcggcuucagcgagacggacgcggcccgcggggccaucaacgcccccaugaccaaggcccuggacugguccggcacccgguacugggcgccggacgcccggaccacgaccuacaacgccgggcgcuucagcacgccccagcccuccggcgcccugcccgggcggaucaacccgcgcacccccauccccgcccggggcagccccuccaucagcuccaacgcgagcaccgccaccuccauccacagcaaccagaccgccuccacccgccucggcagcacggccgggagcggcaccaacguguccagccugccguccaccgcccggacccgcagcuggguggaggaccagaaccggaaccugucccccuucaugcgcggggcgcacaacaucagcuucgucacgccgcccuccagccgguccagcucccagggcaccgugagcaccgugcccaaggacguccucgacuccuggaccggcgccuucaacacgcgccggcagccccuguucgcccacauccgccggcgcggggagagccggguguga

SEQ ID NO: 13156 - RNA, 807 nt, Artificial Sequence
  derived and/or modified sequence opt1 from capsid_protein_VP2__Norovirus__AGE99607
auggccggccccuucuucgccgggcuggcgagcgacgugcucggcuccgggcugggcagccugaucuccgccggggccggcgccaucaaccagaaggucgaguucgagaacaaccgcaagcuccagcaggccagcuuccaguucuccagcaaccugcagcaggcguccuuccagcacgacaaggagaugcugcaggcccagaucgaggccacccagaagcuccagcaggagcugaugaaggugaagcaggccgugcugcucgagggcggguucagcaccacggacgcggcccggggcgccaucaacgccccgaugaccaaggcccuggacugguccgggacccgcuacugggcgcccgacgcccggaucaccacguacaacgccggccgcuucagcacgccccagccccugggggcccucccgggccggaccaacccccgcguccccgccuccgcgcggagcucccccagcucccugagcaacgccccgaccgccaccuccguguacagcaaccagaccgccuccacccgccugggcagcagcgccggguccggcgcgggggugagcucccuccccagcaccgcccggacgcgcuccugggucgaggaccagaacaagaaccugagccccuucaugaagggcgcccugaacaccuccuucgugacgcccccgagcucccggagcuccaaccagggcaccgugagcaccguccccaaggagauccucgacuccuggaccggggccuucaacacccgccggcagccccuguucgcccacauccgcaagcggggcgagagccgcguguga

SEQ ID NO: 13157 - RNA, 807 nt, Artificial Sequence
  derived and/or modified sequence opt1 from capsid_protein_VP2__Norovirus__AGK36312
auggccggcgccuucuucgcggggcuggccagcgacgugcucggcuccgggcugggcagccugaucaacgccggggccggcgccaucaaccagaagaucgacuucgagaacaaccgcgagcuccagcaggcguccuuccaguucagcuccaaccugcagcaggccagcuuccagcacgacaaggagaugcugcaggcccagaucgaggccaccaagaagcuccagcaggagaugaugaaggucaagcaggcgaugcugcuggagggcggguucuccgagaccgacgccgcccggggcgccaucaacgcccccaugacgaaggugcucgacuggagcgggacccgcuacugggcgccggacgcccggaccaccacguacaacgccggccgcuucuccacgccccagcccagcgggacccugcccggccggaucaacccgcgcacccccacccccgcccggggcuccagcuccgccagcuccaacgcgagcaccgccaccuccaucuacagcaaccagaccguguccacgcgccuggggagcaccgccggcagcgggaccaacgucuccagccuccccuccaccgcccggacgcgcagcuggguggaggaccagaaccggaaccuguccccguucaugcgcggcgcccacaacaucagcuucgugaccccgcccuccagccgguccagcucccagggcaccgucagcaccgugcccaaggaggugcuggacuccuggacgggggcguucaacacccgccggcagccccucuucgcccacauccgccggcgcggcgagagccgggucuga

SEQ ID NO: 13158 - RNA, 807 nt, Artificial Sequence; identical to SEQ ID NO: 13129
  derived and/or modified sequence opt1 from capsid_protein_VP2__Norovirus__AGK36315

SEQ ID NO: 13159 - RNA, 639 nt, Artificial Sequence
  derived and/or modified sequence opt1 from capsid_protein_VP2__Norovirus__AGM33209
auggcccaggccaucaucggcgcgaucgccgccagcaccgccggguccgcccugggcgcggggauccaggugggcggggaggccgcccuccagagccagcgcuaccagcagaaccugcagcugcaggagaacuccuucaagcacgaccgggagaugaucggcuaccaggucgaggccagcaaccagcuccuggcgaagaaccuggccacccgcuacucccuccugcgggccggcgggcugacgagcgccgacgccgcgcgcuccguggccggcgcccccgugacccggaucgucgacuggaacggggugcgcgugagcgccccggaguccagcgccaccacccuccgguccggcggguucaugagcguccccauccccuucgcguccaagcagaagcagguccagagcuccggcaucagcaaccccaacuacuccccgagcuccaucagccgcacgaccagcuggguggagucccagaacagcucccgguucggcaaccugagccccuaccacgccgaggcccugaacaccguguggcucaccccgcccggguccacggccagcuccacccugagcuccgugccccgcggcuacuucaacaccgaccggcugccccucuucgccaacaaccgccgguga

SEQ ID NO: 13160 - RNA, 639 nt, Artificial Sequence
  derived and/or modified sequence opt1 from capsid_protein_VP2__Norovirus__AGM33215
auggcccaggccaucaucggcgcgaucgccgccagcaccgccggguccgcccugggcgcggggauccaggugggcggggaggccgcccuccagagccagcgcuaccagcagaaccugcagcugcaggagaacuccuucaagcacgaccgggagaugaucggcuaccaggucgaggccagcaaccagcuccuggcgaagaaccuggccacccgcuacucccuccugcgggccggcgggcugacgagcgccgacgccgcgcgcuccguggccggcgugcccgucacccggaucguggacuggaacggggugcgcgucagcgccccggaguccagcgccaccacccuccgguccggcggguucaugagcgugcccauccccuucgccuccaagcagaagcagguccagagcuccggcaucagcaaccccaacuacuccccgagcuccaucagccgcacgaccagcuggguggagucccagaacagcucccgguucggcaaccugagccccuaccacgcggaggcccugaacaccguguggcucaccccgcccggguccacggccagcuccacccugagcuccgugccccgcggcuacuucaacaccgaccggcugccccucuucgccaacaaccgccgguga

SEQ ID NO: 13161 - RNA, 639 nt, Artificial Sequence; identical to SEQ ID NO: 13159
  derived and/or modified sequence opt1 from capsid_protein_VP2__Norovirus__AGM33218

SEQ ID NO: 13162 - RNA, 639 nt, Artificial Sequence; identical to SEQ ID NO: 13159
  derived and/or modified sequence opt1 from capsid_protein_VP2__Norovirus__AGM33221

SEQ ID NO: 13163 - RNA, 639 nt, Artificial Sequence; identical to SEQ ID NO: 13160
  derived and/or modified sequence opt1 from capsid_protein_VP2__Norovirus__AGM33224

SEQ ID NO: 13164 - RNA, 639 nt, Artificial Sequence; identical to SEQ ID NO: 13159
  derived and/or modified sequence opt1 from capsid_protein_VP2__Norovirus__AGM33227

SEQ ID NO: 13165 - RNA, 639 nt, Artificial Sequence; identical to SEQ ID NO: 13160
  derived and/or modified sequence opt1 from capsid_protein_VP2__Norovirus__AGM33230

SEQ ID NO: 13166 - RNA, 639 nt, Artificial Sequence
  derived and/or modified sequence opt1 from capsid_protein_VP2__Norovirus__AGM33233
auggcccaggccaucaucggcgcgaucgccgccagcaccgccggguccgcccugggcgcggggauccaggugggcggggaggccgcccuccagagccagcgcuaccagcagaaccugcagcugcaggagaacuccuucaagcacgaccgggagaugaucggcuaccaggucgaggccagcaaccagcuccuggcgaagaaccuggccacccgcuacucccuccugcgggccggcgggcugacgagcgccgacgccgcgcgcuccguggccggcgugcccgucacccggaucguggacuggaacggggugcgcgucagcgccccggaguccagcgccaccacccuccgguccggcggguucaugagcgugcccauccccuucgccuccaagcagaagcagauccagagcuccggcaucagcaaccccaacuacuccccgagcuccaucagccgcacgaccagcuggguggagucccagaacagcucccgguucggcaaccugagccccuaccacgcggaggcccugaacaccgucuggcucaccccgcccggguccacggccagcuccacccugagcuccgugccccgcggcuacuucaacaccgaccggcugccccucuucgccaacaaccgccgguga

SEQ ID NO: 13167 - RNA, 639 nt, Artificial Sequence; identical to SEQ ID NO: 13159
  derived and/or modified sequence opt1 from capsid_protein_VP2__Norovirus__AGM33236

SEQ ID NO: 13168 - RNA, 639 nt, Artificial Sequence; identical to SEQ ID NO: 13159
  derived and/or modified sequence opt1 from capsid_protein_VP2__Norovirus__AGM33239

SEQ ID NO: 13169 - RNA, 639 nt, Artificial Sequence; identical to SEQ ID NO: 13159
  derived and/or modified sequence opt1 from capsid_protein_VP2__Norovirus__AGM33242

SEQ ID NO: 13170 - RNA, 639 nt, Artificial Sequence; identical to SEQ ID NO: 13160
  derived and/or modified sequence opt1 from capsid_protein_VP2__Norovirus__AGM33245

SEQ ID NO: 13171 - RNA, 639 nt, Artificial Sequence; identical to SEQ ID NO: 13159
  derived and/or modified sequence opt1 from capsid_protein_VP2__Norovirus__AGT17786

SEQ ID NO: 13172 - RNA, 639 nt, Artificial Sequence; identical to SEQ ID NO: 13159
  derived and/or modified sequence opt1 from capsid_protein_VP2__Norovirus__AGT17793

SEQ ID NO: 13173 - RNA, 807 nt, Artificial Sequence
  derived and/or modified sequence opt1 from capsid_protein_VP2__Norovirus__AGT17796
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaucgagaugcugcaggcccagaucgaggccaccaagaagcuccagcaggagaugaugcgggcgaagcaggccaugcugcuggagggcggguucuccgagaccgacgccgcccgcggcgccaucaacgcgcccaugacgaagacccucgacuggagcgggacccgguacugggccccggacgcccgcaccacgaccuacaacgccggccgguucuccacgccccagcccagcggggcccagcccggccgcgcgaaccugcgggccaccgugccggcccgcggcuccagcuccaccagcuccaacagcuccaucgccaccagcguguacuccaaccagaccaccagcacgcggcuggggagcaccgccggcuccgggaccagcgucuccagccuccccuccaccgcgcgcacgcggagcuggguggaggaccagaaccgcaaccugucccccuucaugcggggcgcccacaacaucagcuucgugacgcccccguccagccgcuccagcucccagggcaccgucagcaccgugcccaaggaggugcuggacuccuggaccggggccuucaacacccggcgccagccccucuucgcccacauccggaagcgcggcgagagccgggucuga

SEQ ID NO: 13174 - RNA, 807 nt, Artificial Sequence
  derived and/or modified sequence opt1 from capsid_protein_VP2__Norovirus__AGT17799
auggccggcgccuucuucgcggggcuggccagcgacgugcucggcuccgggcugggcagccugaucaacgccggggccggcgccaucaaccagaaggucgaguucgagaacaaccgcaagcuccagcaggacuccuuccaguucagcuccaaccugcagcaggcgagcuuccagcacgacaaggagaugcugcaggcccagaucgaggccaccaagaagcuccagcaggagaugaugcgggugaagcaggccaugcugcuggagggcggguucuccgagaccgacgcggcccgcggcgccaucaacgcccccaugacgaaggugcucgacuggagcgggacccgguacugggccccgggcgcgcgcaccaccacguacaacgccggguacuucuccacgccccagcacagcggcgcccugcccggccgggccaaccugcgcgccgucgugcccgcgcggggguccagccgcguguccagcaacuccagcaccgccaccuccgucuacagcaaccagaccgccuccacccggcucggcagcaccgccgggagcggcaccuccgugagcucccugccgagcacggcccgcacccgguccuggguggaggaccagaaccgcaaccugagccccuucaugcggggcgcgcacaacaucuccuucgucaccccgcccagcucccgcagcuccagccaggggaccguguccacggugcccaaggagguccucaacagccaggccggcguguucaacacccggcgccagccccuguucgcccacauccggcgccgcggggagucccgggccuga

SEQ ID NO: 13175 - RNA, 639 nt, Artificial Sequence; identical to SEQ ID NO: 13159
  derived and/or modified sequence opt1 from capsid_protein_VP2__Norovirus__AGT17804

SEQ ID NO: 13176 - RNA, 639 nt, Artificial Sequence; identical to SEQ ID NO: 13159
  derived and/or modified sequence opt1 from capsid_protein_VP2__Norovirus__AGT17807

SEQ ID NO: 13177 - RNA, 639 nt, Artificial Sequence; identical to SEQ ID NO: 13159
  derived and/or modified sequence opt1 from capsid_protein_VP2__Norovirus__AGT17810

SEQ ID NO: 13178 - RNA, 807 nt, Artificial Sequence
  derived and/or modified sequence opt1 from capsid_protein_VP2__Norovirus__AGT17814
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcagucccagaucgacgccaccaagaagcuccagcaggagaugaugcgggugaagcaggccaugcugcuggagggcggguucagcgagaccgacgcggcccgcggcgccaucaacgcccccaugacgaaggugcucgacugguccgggacccgguacugggccccggacgcgcgcaccaccacguacaacgccggccgguucagcacgccccagcccuccggggcgcccccgggccgcgccaaccugcgggccgccguccccgcccgcggcagcuccagcaccuccagcaacuccagcaucgccaccuccauguacagcaaccagaccaccagcacccggcugggguccaccgccggcagcgggacguccgugagcucccuccccagcuccgcccgcacccggagcuggguggaggaccagaaccgcaaccugucccccuucaugcggggcgcgcacaacaucagcuucgucaccccgcccuccagccgcuccagcucccagggcaccgugagcacggugcccaaggagguccuggacuccuggaccggggccuucaacacccggcgccagccccucuucgcccacauccggcgccggggcgagagccgcguguga

SEQ ID NO: 13179 - RNA, 807 nt, Artificial Sequence
  derived and/or modified sequence opt1 from capsid_protein_VP2__Norovirus__AGT17820
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggcgaagcaggccaugcugcuggagggcggguucuccgagaccgacgccgcccgcggcgccaucaacgcgcccaugacgaagacccucgacuggagcgggacccgguacugggccccggacgcccgcaccacgaccuacuccgccggccgguucagcacgccccagcccuccggggcccugcccggccgcgcgaaccugcgggccaccgugccggcccgcggcagcuccagcaccuccagcaacuccagcaucgccaccuccguguacagcaaccagaccaccagcacgcggcucggguccaccgccggcagcgggaccuccgucagcucccugcccagcaccgcgcgcacgcgguccuggguggaggaccagaaccgcaaccugagccccuucaugcggggcgcccacaacaucuccuucgugacgcccccgagcucccgcagcuccagccagggcaccgucuccaccgugcccaaggaggugcucgacagcuggaccggggccuucaacacccggcgccagccccuguucgcccacauccggaagcgcggcgagucccgggucuga

SEQ ID NO: 13180 - RNA, 807 nt, Artificial Sequence
  derived and/or modified sequence opt1 from capsid_protein_VP2__Norovirus__AGT17824
auggccggcgccuucuucgcggggcuggccagcgacgugcucggcuccgggcugggcagccugaucaacgccggggccggcgccaucaaccagaaggucgaguucgagaacaaccgcaagcuccagcaggacuccuuccaguucagcuccaaccugcagcaggcgagcuuccagcacgacaaggagaugcugcaggcccagaucgaggccaccaagaagcuccagcaggagaugaugcgggugaagcaggccaugcugcuggagggcggguucuccgagaccgacgcggcccgcggcgccaucaacgcccccaugacgaaggugcucgacuggagcgggacccgguacugggccccggacgcgcgcaccaccacguacaacgccggccacuucuccacgccccagcacagcggggcccugcccggccgggccaaccugcgcgccaccguccccgcgcggggcuccagccgcgccuccagcaacuccagcaccgccaccuccguguacagcaaccagaccaccuccacccggcucgggagcacggccggcagcgggaccuccgugagcucccugccgagcaccgcccgcacccgguccugggucgaggaccagaaccgcaaccugagccccuucaugcggggcgcgcacaacaucuccuucgugacgccgcccagcucccgcagcuccagccagggcaccguguccaccguccccaaggaggugcucaacagccggaccggggccuucaacacgcgccggcagccccuguucgcccacauccgccggcagggcgagucccgcgccuga

SEQ ID NO: 13181 - RNA, 639 nt, Artificial Sequence; identical to SEQ ID NO: 13159
  derived and/or modified sequence opt1 from capsid_protein_VP2__Norovirus__AGT17827

SEQ ID NO: 13182 - RNA, 807 nt, Artificial Sequence
  derived and/or modified sequence opt1 from capsid_protein_VP2__Norovirus__AGT17831
auggccggcgccaucaucgcggggcuggccagcgacgugcucuccagcggccuggggucccugaucaacgccggcgccggggucaucaaccagaagguggacuucgagaacaacaagcagcuccagcagaacagcuuccaguucuccagcaaccugcagcaggccuccuuccagcacgacaaggagaugcugcaggcgcagaucgaggccaccaagaagcuccagcaggagaugaugggcaucaagcaggccgugcugcugaagggcggguucagcgagaccgacgccgcgcgcggcgccgucaacgcccccaugacgaaggugcucgacugguccgggacccgguacugggccccgaacgccagcaccaccacguacaacgcgggccgcuucuccacgccccagcccagcggggcccugcccggccggaccaaccugcgcaccgccgccccggcccggggcucccccagcaucuccagcaacgcguccaccgccaccagcguguacuccaaccagaccgucagcacccgccucgggacgagcgccggcuccgggaccagcguguccagccugcccuccaccgcccggacccgcagcuggguggaggaccagaaccggaaccugucccccuucaugcgcggcgcccacaacaucagcuucgucacgccgcccuccagccgguccagcucccagggcaccgugagcaccgugcccaaggagguccucgacuccuggaccggggcguucaacacgcgccggcagccccuguucgcccacauccgcaagcggggcgagagccgcguguga

SEQ ID NO: 13183 - RNA, 639 nt, Artificial Sequence; identical to SEQ ID NO: 13159
  derived and/or modified sequence opt1 from capsid_protein_VP2__Norovirus__AGT17837

SEQ ID NO: 13184 - RNA, 807 nt, Artificial Sequence
  derived and/or modified sequence opt1 from capsid_protein_VP2__Norovirus__AGT17843
auggccggcgccuucuucgcggggcuggccagcgacgugcucggcuccgggcugggcagccugaucaacgccggggccggcgccaucaaccagaaggucgaguucgagaacaaccgcaagcuccagcaggacuccuuccaguucagcuccaaccugcagcaggcgagcuuccagcacgacaaggagaugcugcaggcccagaucgaggccaccaagaagcuccagcaggagaugaugcgggugaagcaggccaugcugcuggagggcggguucuccgagaccgacgcggcccgcggcgccaucaacgcccccaugacgaaggugcucgacuggaacgggacccgguacugggccccgggcgcgcgcaccaccacguacaacgccgggcacuucagcacgccccagcacuccggcgcccugcccggccgggccaaccugcgcgccgcgguccccgcccgggggagcucccgcgccagcuccaacagcuccaccgccaccagcguguacuccaaccagaccaccagcacccggcucggcuccaccgccgggagcggcacgagcguguccagccugccguccaccgcgcgcacccggagcugggucgaggaccagaaccgcaaccugucccccuucaugcggggcgcccacaacaucagcuucgugaccccgcccuccagccgcuccagcucccaggggacggugagcaccguccccaaggaggugcucaacucccagaccggcgccuucaacacccggcgccagccccuguucgcccacauccggcgccgcggggagagccgggccuga

SEQ ID NO: 13185 - RNA, 807 nt, Artificial Sequence
  derived and/or modified sequence opt1 from capsid_protein_VP2__Norovirus__AGX85887
auggccggcgccuucuucgcggggcuggccagcgacgugcucuccagcggccuggggucccugaucaacgccggcgccggggccaucaaccagaccgucgaguucgagaacaaccgcaagcuccagcaggcgagcuuccaguucuccagcaaccugcagcaggccuccuuccagcacgacaaggagaugcugcagagccagaucgacgccaccaagaagcuccagcaggagaugaugcgggugaagcaggccaugcugcuggagggcggcuucuccgagacggacgcggcccgcggggccaucaacgcccccaugaccaaggugcucgacuggagcggcacccgguacugggccccggacgcgcgcaccacgaccuacaacgccgggcgguucuccacgccccagagcuccggcgccccgcccgggcgcgccaaccugcgggccgcgguccccgcccagggcagcuccagcaccuccagcaacuccagcaucgccaccagcauguacuccaaccagaccaccagcacccgccugggcuccacggccgggagcggcaccuccgugagcucccuccccagcuccgcccggacccgcagcuggguggaggaccagaaccggaaccugucccccuucaugcgcggggcgcacaacaucagcuucgucacgcccccguccagccgguccagcucccagggcaccgugagcaccgugcccaaggagguccuggacuccuggaccggcgccuucaacacccgccggcagccccucuucgcccacauccgccggcgcggggagagccggguguga

SEQ ID NO: 13186 - RNA, 807 nt, Artificial Sequence
  derived and/or modified sequence opt1 from capsid_protein_VP2__Norovirus__AGX85893
auggccggcgccuucuucgcggggcuggccagcgacgugcucggcuccgggcugggcagccugaucaacgccggggccggcgccaucaaccagaaggucgaguucgagaacaaccgcaagcuccagcaggacuccuuccaguucagcuccaaccugcagcaggcgagcuuccagcacgacaaggagaugcugcaggcccagaucgaggccaccaagaagcuccagcaggagaugaugcgggugaagcaggccaugcugcuggagggcggguucuccgagaccgacgcggcccgcggcgccaucaacgcccccaugacgaaggugcucgacuggagcgggacccgguacugggccccgggcgcgcgcaccaccacguacaacgccggguacuucuccacgccccagcacagcggcgcccugcccggccgggccaaccugcgcgccgcgguccccgcccggggguccagccgcguguccagcaacuccagcaccgccaccuccguguacagcaaccagaccgccuccacccggcucggcagcaccgccgggagcggcaccuccgucagcucccugccgagcacggcgcgcacccgguccuggguggaggaccagaaccgcaaccugagccccuucaugcggggcgcccacaacaucuccuucgugaccccgcccagcucccgcagcuccagccaggggaccgucuccacggugcccaaggaggugcucaacagccagaccggcgucuucaacacccggcgccagccccuguucgcccacauccggcgccgcggggagucccgggccuga

SEQ ID NO: 13187 - RNA, 807 nt, Artificial Sequence
  derived and/or modified sequence opt1 from capsid_protein_VP2__Norovirus__AGX85896
auggccggcgccuucuucgcggggcuggccagcgacgugcucggcuccgggcugggcagccugaucaacgccggggccggcgccaucaaccagaaggucgaguucgagaacaaccgcaagcuccagcaggacuccuuccaguucagcuccaaccugcagcaggcgagcuuccagcacgacaaggagaugcugcaggcccagaucgaggccaccaagaagcuccagcaggagaugaugcgggugaagcaggccaugcugcuggagggcggguucuccgagaccgacgcggcccgcggcgccaucaacgcccccaugacgaaggugcucgacuggagcgggacccgguacugggccccgggcgcgcgcaccaccacguacaacgccggguacuucuccacgccccagcacagcggcgcccugcccggccgggccaaccugcgcgccgcgguccccgcccggggguccagccgcguguccagcaacuccagcaccgccaccuccguguacagcaaccagaccgccuccacccggcucggcagcaccgccgggagcggcaccuccgucagcucccugccgagcacggcgcgcacccgguccuggguggaggaccagaaccgcaaccugagccccuucaugcggggcgcccacaacaucuccuucgugaccccgcccagcucccgcagcuccagccaggggaccgucuccacggugcccaaggaggugcucaacagccagaccggcgccuucaacacccggcgccagccccuguucgcccacauccggcgccgcggggagucccgggccuga

SEQ ID NO: 13188 - RNA, 807 nt, Artificial Sequence
  derived and/or modified sequence opt1 from capsid_protein_VP2__Norovirus__AGX85905
auggccggcgccuucuucgcggggcuggccagcgacgugcucuccagcggccuggggucccugaucaacgccggcgccggggccaucaaccagcgcaucgacuucgagaacaaccggaagcuccagcaggcgagcuuccaguucuccagcaaccugcagcaggccuccuuccagcacgacaaggagaugcugcaggcccagaucgaggccaccaagaagcuccagcaggagcugaugaaggucaagcaggcgaugcugcucgagggcggcuucagcgagaccgacgccgcccgcggggccaucaacgcccccaugacgaaggcgcuggacugguccggcacccgguacugggccccggacgcccgcaccaccacguacaacgccgggcgguucagcacgccccagcccuccggcgcccugcccgggcgcaucaacccgcggacccccauccccgcgcgcggcagccccuccaucagcuccaacgugagcaccgccaacuccauccacagcaaccagaccgccuccacccggcucggcagcaccgccgggagcggcaccgacguguccagccugccguccacggcccgcacccggagcugggucgaggaccagaaccgcaaccugucccccuucaugcgcggggcgcacaacaucagcuucgugaccccgcccuccagccgguccagcucccagggcaccgugagcacgguccccaaggacgugcucgacuccuggaccggcgccuucaacacccggcgccagccccuguucgcccacauccggcgccgcggggagagccggguguga

SEQ ID NO: 13189 - RNA, 807 nt, Artificial Sequence
  derived and/or modified sequence opt1 from capsid_protein_VP2__Norovirus__AGX85914
auggccggcgccuucuucgcggggcuggccagcgacgugcucggcuccgggcugggcagccugaucaacgccggggccggcgccaucaaccagaaggucgaguucgagaacaaccgcaagcuccagcaggacuccuuccaguucagcuccaaccugcagcaggcgagcuuccagcacgacaaggagaugcugcaggcccagaucgaggccaccaagaagcuccagcaggagaugaugcgggugaagcaggccaugcugcuggagggcggguucuccgagaccgacgcggcccgcggcgccaucaacgcccccaugacgaaggugcucgacuggagcgggacccgguacugggccccgggcgcgcgcaccaccacguacaacgccggguacuucuccacgccccagcacagcggcgcccugcccggccgggccaaccugcgcgccgucgugcccgcgcggggguccagccgcguguccagcaacuccagcaccgccaccuccgucuacagcaaccagaccgccuccacccggcucggcagcaccgccgggagcggcaccuccgugagcucccugccgagcacggcccgcacccgguccuggguggaggaccagaaccgcaaccugagccccuucaugcggggcgcgcacaacaucuccuucgucaccccgcccagcucccgcagcuccagccaggggaccguguccacggugcccaaggagguccucaacagccagaccggcguguucaacacccggcgccagccccuguucgcccacauccggcgccgcggggagucccgggccuga

SEQ ID NO: 13190 - RNA, 807 nt, Artificial Sequence; identical to SEQ ID NO: 13185
  derived and/or modified sequence opt1 from capsid_protein_VP2__Norovirus__AGX85917

SEQ ID NO: 13191 - RNA, 807 nt, Artificial Sequence; identical to SEQ ID NO: 13182
  derived and/or modified sequence opt1 from capsid_protein_VP2__Norovirus__AGX85923

SEQ ID NO: 13192 - RNA, 807 nt, Artificial Sequence
  derived and/or modified sequence opt1 from capsid_protein_VP2__Norovirus__AGX85926
auggccggcgccaucaucgcggggcuggccagcgacgugcucuccagcggccuggggucccugaucaacgccggcgccggggccaucaaccagaccaucgacuucgagaacaaccgcaagcuccagcaggcgagcuuccaguucuccagcaaccugcagcaggccuccuuccagcacgacaaggagaugcugcaggcccagaucgaggccaccaagaagcuccagcaggagaugaugcgggucaagcaggcgaugcugcuggagggcggcuucagcgagacggacgccgcccgcggggccaucaacgcccccaugaccaagacccucgacugguccggcacccgguacugggcgccggacgcccgcacgaccaccuacaacgccgggcgguucagcacgccccagcccuccggcgcgcccccggggcgcgccaaccugcgggccaccacccccgcccgcggcagcuccagcaccuccagcaacuccagcaucgccaccuccguguacagcaaccagacgaccagcacccggcugggcuccaccgccgggagcggcacguccgugagcucccuccccagcaccgcccgcacccgguccugggucgaggaccagaaccgcaaccugagccccuucaugcgcggggcgcacaacaucuccuucgugaccccgcccagcucccggagcuccagccagggcacgguguccaccguccccaaggaggugcuggacagcuggaccggcgccuucaacacccggcgccagccccucuucgcccacauccggacgcgcggggagucccggguguga

SEQ ID NO: 13193 - RNA, 807 nt, Artificial Sequence; identical to SEQ ID NO: 13189
  derived and/or modified sequence opt1 from capsid_protein_VP2__Norovirus__AGX85932

SEQ ID NO: 13194 - RNA, 807 nt, Artificial Sequence; identical to SEQ ID NO: 13189
  derived and/or modified sequence opt1 from capsid_protein_VP2__Norovirus__AGX85935

SEQ ID NO: 13195 - RNA, 780 nt, Artificial Sequence
  derived and/or modified sequence opt1 from capsid_protein_VP2__Norovirus__AHI59155
auggccagcgccuuccuggcgggccucgccggggacgugaucaccaacggcgucgggucccugaucaacgccggcgccaacgccgugaaccagaagguggaguacgacuucaacaagcagcugcagauggcgagcuucaagcacgacaaggagaugcuccagucccagguccuggccaccaagcagcugcagcaggagaugaugaacauccgccagggggugcucacggccggcggcuucagccccgccgacgcggcccgcggggccgugaacgccccgaugaccaagauccuggacuggaacggcacccgguacugggcccccaacuccaugaagaccacgagcuacuccgggcaguucagcuccagccccguccacaagucccccgcgccgagccagcacaccgcccugcccaagucccggcuccagaacgacuucgccagcguguacuccuuccccagcuccgugagcucccagagcacccacagcaccgcccuguccgccggcacggggagcucccgcagcaucucccccagcaccgcgaccccgacccugucccggacgagcgacuggguccgcggccagaacgagcggcucucccccuucauggacggcgcccugcagaccgccuucgugaccccgcccagcuccaaggccagcuccaacgggaccgugagcacgguccccaaggccgugcuggacuccuggacccccauguucaacacccaccgccagccccucuucgcgcacccccggcgccggggcgagagccagguguga

SEQ ID NO: 13196 - RNA, 807 nt, Artificial Sequence
  derived and/or modified sequence opt1 from capsid_protein_VP2__Norovirus__AHI59158
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggagcgggacccgguacugggcgccggacgcccgcaccacgaccuacaacgccggccgguucuccacgccccagcccagcggggcccugcccggccgcgccaaccugcgggcgaccgugccggcccgcggcuccagcaacaccuccagcuccagcuccaucgccaccagcgucuacuccaaccagaccaccagcacgcggcucgggagcaccgccggcuccgggaccagcguguccagccugcccuccaccgcccgcacgcggagcuggguggaggaccagaaccgcaaccugucccccuucaugcggggcgcgcacaacaucagcuucgucacgcccccguccagccgcuccagcucccagggcaccgugagcaccgugcccaaggagguccucgacuccuggaccggggccuucaacacccggcgccagccccuguucgcccacauccggaagcgcggcgagagccggguguga

SEQ ID NO: 13197 - RNA, 780 nt, Artificial Sequence
  derived and/or modified sequence opt1 from capsid_protein_VP2__Norovirus__AHI59160
auggccggcgccuucguggcggggcuggccggcgacguccugagcaacgggcuguccagccugaucaacgccggcgccaacgccaucaaccagcgcgcggaguucgacuucaaccagaagcuccagcagaacuccuucaaccacgacaaggagaugcugcaggcccagauccaggccaccaagcagcugcaggccgacaugauggcgaucaagcagggggugcucaccgccggcggcuucagccccgccgacgccgcccgcggggcggugaacgccccgaugacgcaggcccuggacuggaacggcacccgguacugggcccccggguccaugcggaccaccagcuacuccggcaaguucacgagcaccgcccccguccgccaggcggacuuccagcacacccagucccggcccagcuccgggagcuccgugagcuccuucgccacccagagcucccgcccgacgcugaccaccaccacgggcagcucccacggcaccgccagcagcaacuccacccggagcaccucccucagccaguccacggugagccgcgccaccucccggaccagcgaguggguccgcgaccagaaccggaaccuggagcccuacaugcacggggcccugcagaccgcguucgugacgccgcccuccagccgcgccuccgacggcaccgugagcaccguccccaagggggugcucgacuccuggacccccgccuucaacacgcggcgccagccccuguucgcccaccuccggaagcgcggcgagagccacgccuga

SEQ ID NO: 13198 - RNA, 807 nt, Artificial Sequence
  derived and/or modified sequence opt1 from capsid_protein_VP2__Norovirus__AHI59163
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggagcgggacccgguacugggcgccggacgcccgcaucaccacguacaacgccggccgguuccccacgccccagcuguccggggcccugcccggccgcgccaaccuccgggcgaccgugccggcccgcggcagccccuccaccagcuccaacagcuccaucgccaccagcgucuacuccaaccagaccaccagcacccggcugggguccacggccggcagcgggaccagcguguccagccugcccuccaccgcccgcacccggagcuggguggaggaccagaaccgcaaccucucccccuuccugcggggcgcgcacaacaucagcuucgucacgccgcccuccagccgcuccagcucccagggcaccgugagcaccgugcccaaggagguccuggacuccuggaccggggccuucaacacgcggcgccagccccucuucgcccacauccggaagcgcggcgagagccggguguga

SEQ ID NO: 13199 - RNA, 807 nt, Artificial Sequence
  derived and/or modified sequence opt1 from capsid_protein_VP2__Norovirus__AHI59166
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcagggcaugaugaaggugaagcaggcgaugcugcuggagggcggguucuccgagaccgacgccgcccgcggggccaucaacgcccccaugacgaaggcgcucgacuggagcggcacccgguacugggccccggacgcccggaccaccacguacaacgccgggcgcuucuccacgccccagcccagcggcgcccugcccggccggaacaaccugcgcgcgaccgugccggcccggggguccagcuccacccucagcuccauccccaccgccaccagcgucuacuccaaccagaccgugagcacccgccugggcuccagcgccgggagcggcacguccgugagcucccugcccagcaccgcccggacccgcuccugggucgaggaccagaacaagaaccucagccccuucaugcggggcgcgcugaacaccuccuucgugacgccgcccagcucccgcagcuccagccaggggaccguguccaccguccccaaggagauccuggacagcuggaccggcgccuucaacacgcggcgccagccccucuucgcccacgugcggaagcgcggggagucccggguguga

SEQ ID NO: 13200 - RNA, 807 nt, Artificial Sequence
  derived and/or modified sequence opt1 from capsid_protein_VP2__Norovirus__AHX22026
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggucaugcugcuggagggcggguucuccgagaccgacgcggcccgcggcgccaucaacgcccccaugacgaaggcccucgacuggagcgggacccgguacugggcgccggacgcccgcaccaccacguacaacgccggccgguucuccacgccccagcccagcggggcccugcccggccgcgccaaccugcgggugaccgcgccggcccgcggcuccagcuccaccagcuccaacagcuccaucgccaccagcguguacuccagccagaccaccagcacccggcucggguccacggccggcagcgggaccuccgugagcucccugcccagcaccgcccgcacccgguccugggucgaggaccagaaccgcaaccugagccccuucaugcggggcgcgcacaacaucuccuucgugacgcccccgagcucccgcagcuccagccagggcaccguguccaccguccccaaggaggugcucgacagcuggaccggggccuucaacacgcggcgccagccccuguucgcccacauccggaagcgcggcgagucccggguguga

SEQ ID NO: 13201 - RNA, 807 nt, Artificial Sequence
  derived and/or modified sequence opt1 from capsid_protein_VP2__Norovirus__AHX22029
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggugaagcaggucaugcugcuggagggcggguucuccgagaccgacgcggcccggggcgccaucaacgcccccaugacgaaggcccucgacuggagcgggacccgcuacugggcgccggacgcccggaccaccacguacaacgccggccgcuucuccacgccccagcccagcggggugcugcccggccgggccaaccugcgcgacgccgugccggcgcggggcuccagcuccaagagcuccaacagcuucaccgccaccuccguguacagcaaccagaccaccuccacccgccucgggagcaccgccggcagcgggacguccgucagcucccugcccagcaccgcccggacccgcuccuggguggaggaccagagccggaacgugucccccuucaugcgcggcgcccacaacaucagcuucgucacgcccccguccagccgguccagcucccagggcaccgugagcaccgugcccaaggagguccuggacuccuggaccggggcguucaacacccgccggcagccccucuucgcccacauccgcaagcggggcgagagccgcguguga

SEQ ID NO: 13202 - RNA, 807 nt, Artificial Sequence
  derived and/or modified sequence opt1 from capsid_protein_VP2__Norovirus__AHX22033
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggucaugcugcuggagggcggguucuccgagaccgacgcggcccgcggcgccaucaacgcccccaugacgaaggcccucgacuggagcgggacccgguacugggcgccggacgcccgcaccaccacguacaacgccggccgguucuccacgccccagcccagcggggcccuguccggccgcgccaaccugcgggcgaccgcccccgcccgcggcagcuccagcaccuccagcaacuccagcaucgccaccuccguguacagcaaccagaccaccagcacccggcucggguccacggccggcagcgggaccuccgugagcuccccgcccagcaccgcgcgcacccgguccuggguggaggaccagaaccgcaaccugagccccuucaugcggggcgcccacaacaucuccuucgucacgcccccgagcucccgcagcuccagccagggcaccguguccaccgugcccaaggagguccuggacagcuggaccggggccuucaacacgcggcgccagccccucuucgcccacauccggaagcgcggcgagucccggguguga

SEQ ID NO: 13203 - RNA, 807 nt, Artificial Sequence
  derived and/or modified sequence opt1 from capsid_protein_VP2__Norovirus__AHX22036
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaagacccucgacuggagcgggacccgguacugggcgccggacgcccgcaccacgaccuacaacgccggccgguucuccacgccccagcccagcggggcccugcccggccgcgccucccugcgggcgaccgugccggcccgcggcagcuccagcauguccagcaacuccagcaucgccaccuccgucuacagcaaccagaccaccagcacccggcucggguccacggccggcagcgggaccuccgugagcucccugcccagcaccgcccgcacccgguccuggguggaggaccagaaccgcaaccugagccccuucaugcggggcgcgcacaacaucuccuucgucacgcccccgagcuccaucagcuccagccagggcaccguguccaccgugcccaaggagguccucgacagcuggaccggggccuucaacacgcgccggcagccccuguucgcccacauccgcaagcggggcgagucccgcguguga

SEQ ID NO: 13204 - RNA, 807 nt, Artificial Sequence
  derived and/or modified sequence opt1 from capsid_protein_VP2__Norovirus__AHX22039
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggugaagcaggcgaugcugcuggagggcggguucuccgagaccgacgccgcccggggcgccaucaacgcccccaugacgaaggcgcucgacuggagcgggacccgcuacugggccccggacgcccggaccaccacguacaacgccggccgcuucuccacgccccagcccagcggggcccugcccggccgggcgaaccugcgcgacgccgugccggcccggggcuccagcuccaagagcuccaacagcuccaccgccaccagcgucuacuccaaccagaccaccagcacccgccucgggagcaccgccggcuccgggacgagcguguccagccugcccuccaccgcgcggacccgcagcuggguggaggaccagucccggaaccugagccccuucaugcgcggcgcccacaacaucuccuucgucacgcccccgagcucccggagcuccagccagggcaccguguccaccgugcccaaggagguccucgacagcuggaccggggccuucaacacccgccggcagccccuguucgcccacauccgcaagcggggcgagucccgcguguga

SEQ ID NO: 13205 - RNA, 807 nt, Artificial Sequence
  derived and/or modified sequence opt1 from capsid_protein_VP2__Norovirus__AHX22042
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggugaagcaggcgaugcugcuggagggcggguucuccgagaccgacgccgcccggggcgccaucaacgcccccaugacgaaggcgcucgacuggagcgggacccgcuacugggccccggacgcccggaccaccacguacaacgccggccgcuucuccacgccccagcccagcggggugcugcccggccgggccaaccugcgcgacgcggucccggcccggggcuccagcuccaagagcuccaacagcuucaccgccaccuccguguacagcaaccagaccaccuccacccgccucgggagcaccgccggcagcgggacguccgugagcucccugcccagcaccgcccggacccgcuccugggucgaggaccagagccggaaccugucccccuucaugcgcggcgcgcacaacaucagcuucgugacgcccccguccagccgguccagcucccagggcaccgugagcaccguccccaaggaggugcucgacuccuggaccggggccuucaacacccgccggcagccccuguucgcccacauccgcaagcggggcgagagccgcguguga

SEQ ID NO: 13206 - RNA, 807 nt, Artificial Sequence
  derived and/or modified sequence opt1 from capsid_protein_VP2__Norovirus__AHX22048
auggccggcgccuucuucgcggggcuggccagcgacgugcucggcuccgggcugagcucccugaucaacgccggcgccggggccaucaaccagaaggucgaguucgagaacaaccgcaagcuccagcaggcgagcuuccaguucuccagcaaccugcagcaggccuccuuccagcacgacaaggagaugcugcaggcccagaucgaggccaccaagaagcuccagcaggagaugaugcgggugaagcaggcgaugcugcuggagggcggcuucagcgagaccgacgccgcccgcggggccaucaacgcccccaugacgaaggcgcucgacugguccggcacccgguacugggccccggacgcccgcaccaccacguacaacgccgggcgguucagcacgccccagcccuccggcgcccugcccgggcgcgcgaaccugcgggccgccgugccggcccgcggcagcuccagcauguccagcaacuccagcaccgccaccuccgucuacagcaaccagaccaccagcacccggcucggcuccaccgcggggagcggcacguccgugagcucccugcccagcaccgcccgcauccgguccuggguggaggaccagaaccgcaaccugagccccuucaugcgcggggcccacaacaucuccuucgucacgcccccgagcucccggagcuccagccagggcaccguguccaccgugcccaaggagguccucgacagcuggaccggcgccuucaacacccggcgccagccccuguucgcccacauccggaagcgcggggagucccgggcguga

SEQ ID NO: 13207 - RNA, 807 nt, Artificial Sequence; identical to SEQ ID NO: 13203
  derived and/or modified sequence opt1 from capsid_protein_VP2__Norovirus__AHX22051

SEQ ID NO: 13208 - RNA, 807 nt, Artificial Sequence
  derived and/or modified sequence opt1 from capsid_protein_VP2__Norovirus__AHX22055
auggccggcgccuucuucgcggggcuggccagcgacgugcucggcuccgggcugagcucccugaucaacgccggcgccggggccaucaaccagaaggucgaguacgagaacaaccgcaagcuccagcaggcgagcuuccaguucuccagcaaccugcagcaggccuccuuccagcacgacaaggagaugcugcaggcccagaucgaggccaccaagaagcuccagcaggagaugaugcgggugaagcaggcgaugcugcuggagggcggcuucagcgagaccgacgccgcccgcggggccaucaacgcccccaugacgaagacccucgacugguccggcacccgguacugggcgccggacgcccgcaccacgaccuacaacgccgggcgguucagcacgccccagcccuccggcgcccugcccgggcgcgccaaccugcgggcgaccgugccggcccgcggcagcuccagcaccuccagcaacuccagcaucgccaccuccgucuacagcaaccagaccacccucacgcggcugggcagcaccgccggguccggcaccagcguguccagccugcccuccaccgcccgcacgcggagcuggguggaggaccagaaccgcaaccucucccccuucaugcgcggggcgcacaacaucagcuucgucacgcccccguccagccgguccagcucccagggcaccgugagcaccgugcccaaggagguccuggacuccuggaccggcgccuucaacacccggcgccagccccuguucgcccacauccggaagcgcggggagagccggguguga

SEQ ID NO: 13209 - RNA, 693 nt, Artificial Sequence
  derived and/or modified sequence opt1 from capsid_protein_VP2__Norovirus__AII02849
auggccggcgccuucaucgcggggcuggccggcgacaugcucaccaacaccguggggagccuggucaacgccggcgccaacgccaucaaccagacgaucgacuucgagaacaacaaguaccugcagaacgcguccuucaaccacgacaaggagaugcucaacgcccagaucgaggccaccaagcgccugcaggccgacaugaucgcgaucaagcagggggugcugaccgccggcggcuucagccccaccgacgccgcccgcggggccaucaacgcgcccaugacgaaggugcucgacuggaacggcacccgguacugggcccccggggccaccuccaccacgagcauguccggcggguucaucaaccagaccguccaccggagcacccccaacuucaagaccaaccaggcccccaagccggcccccuccagcggcuccagcgugcgcuccaacagcacgcagaucaccucccugagcucccacagcuccggcagcucccggagcagcggguccaccguggucagcuccauccccagcuccaaccgcacccgggacugggugaaccagcagaacuucaaccuggagccccacaugccgggcagccuccgcacggcguucgugaccccgcccuccagcaccgccuccagcuccgggaccgucagcacggugcccaagaacgugcuggacuccuga

SEQ ID NO: 13210 - RNA, 804 nt, Artificial Sequence
  derived and/or modified sequence opt1 from capsid_protein_VP2__Norovirus__AKE07101
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggugaagcaggcggugcugcuggagggcggguucuccgagaccgacgccgcccggggcgccaucaacgcccccaugacgaaggcgcucgacuggagcgggacccgcuacugggccccggacgcccggaccaccacguacaacgccggccacuucuccacgccccagcccagcggggcgccccugggccgcgccaaccugcgggccgccgucccgacccgcggcuccagcuccaccagcuccaacagcuccaucgccaccagcguguacuccaaccagaccgccagcacccggcucgggagcaccgcgggcuccggggccagcguguccagccugcccuccacggcccgcacccggagcugggucgaggaccagcgcaaccugucccccuucaugcggggcgcccacaacaucagcuucgugacgcccccguccagccgcuccagcucccagggcaccgugagcaccguccccaaggaggugcucgacuccuggaccggggccuucaacacccggcgccagccccuguucgcgcacauccggaagcgcggcgagagccggguguga

SEQ ID NO: 13211 - RNA, 807 nt, Artificial Sequence
  derived and/or modified sequence opt1 from capsid_protein_VP2__Norovirus__AKE07104
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggugaagcaggcggugcugcuggagggcggguucuccgagaccgacgccgcccggggcgccaucaacgcccccaugacgaaggcgcucgacuggagcgggacccgcuacugggccccggacgcccggaccaccacguacaacgccggccgcuucuccacgccccagcccagcgggauccugcccggccgggccaaccugcgcgacaccgucccggcgcggggcuccagcuccaccagcuccaagagcuccaucgccaccagccucuacuccaaccagaccgccaccacccgccuggggagcacggccggcagcgggaccuccgugagcucccugcccagcaccgcccggacccgcuccuggguggaggaccagaaccggaaccucagccccuucaugcgcggcgcgcacaacaucuccuucgucacgcccccgagcucccggagcuccagccagggcaccguguccaccgugcccaaggagguccuggacagcuggaccggggccuucaacacgcgccggcagccccuguucgcccacauccgcaagcggggcgagucccgcguguga

SEQ ID NO: 13212 - RNA, 807 nt, Artificial Sequence
  derived and/or modified sequence opt1 from capsid_protein_VP2__Norovirus__AKE07107
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggacaugcugcaggcccagaucgaggccaccaagaagcuccagcaggagaugaugcgggugaagcaggcgaugcugcuggagggcggguucuccgagaccgacgccgcccgcggcgccaucaacgcccccaugacgaaggcgcucgacuggagcgggacccgguacugggccccggacgcccgcaccaccacguacaacgccggccacuucuccacgccccagcccagcggggcccugcccggccgggcgaaccugcgcgccgccgugccggcccggggccccuccagcaccuccagcaacuccagcaccgccaccuccgucuacagcaaccagaccaccuccacccgccucgggagcacggcgggcagcggggccuccgugagcucccugcccagcaccgcccggaccgugaacuggguccgcgaccagaaccggucccugagccccuucaugcgcggcgcccacaacaccuccuucgugacgccgcccagcucccggagcuccagccagggcaccguguccaccguccccaaggaggugcucgacagcuggaccggggccuucaacacgcgccggcagccccuguucgcgcacauccgcacccggggcgagucccgcguguga

SEQ ID NO: 13213 - RNA, 765 nt, Artificial Sequence
  derived and/or modified sequence opt1 from capsid_protein_VP2__Norovirus__ALE30634
auggccggcgccuucaucgcggggcuggccggcgacaugcucaccaacaccguggggagccuggucaacgccggcgccggggccaucaaccagaagguggacuucgagaacaacaaguaccugcagaacgcguccuucaaccacgacaaggagaugcucaacgcccagaucgaggccacgaagcgccugcaggccgacaugaucgcgaucaagcagggcgugcugaccgccggcggguucagccccaccgacgccgcccggggcgccaucaacgcgccgaucaccaagguccucgacugguccgggacgcgcuacugggcccccaacgccaccagcaccaccuccaugagcggcggguucacgggccaggccgugcaccgggccacccccaacuucaagaccaaccaggcgcccaaguccaccccgagcuccggcagcuccgugcgcagcuccagcacgcagcugaccaaccuguccagccacuccagcggguccagccggagcuccggcagcaccauggucuccagccuccccuccagcucccgcacccgggacugggugaaccagcagaacuucaaccuggagccccacaugcccgggagccugcgcacggccuucgugaccccgcccuccagcaccgccuccagccucgacaccgucuccacggugcccaagagcgugcuggacuccuggacccccgccuucaacacccggcgccagccgcuguucgcccaccuccggcgccggggcgagagcaacaucuga

SEQ ID NO: 13214 - RNA, 765 nt, Artificial Sequence
  derived and/or modified sequence opt1 from capsid_protein_VP2__Norovirus__ALE30636
auggccggcgccuucaucgcggggcuggccggcgacaugcucaccaacaccguggggagccuggucaacgccggcgccggggccaucaaccagaagguggacuucgagaacaacaaguaccugcagaacgcguccuucaaccacgacaaggagaugcucaacgcccagaucgaggccacgaagcgccugcaggccgacaugaucgcgaucaagcagggcgugcugaccgccggcggguucagccccaccgacgccgcccggggcgccaucaacgcgccgaucaccaagguccucgacugguccgggacgcgcuacugggcccccaacgccaccagcaccaccuccaugagcggcggguucacgggccaggccgugcaccgggccacccccaacuucaagaccaaccaggcgcccaaguccaccccgagcuccggcagcuccgugcgcagcuccagcacgcagcugaccaaccuguccagccacuccagcggguccagccggagcuccggcagcaccauggucuccagccuccccuccagcucccgcacccgggacugggugaaccagcagaacuucaaccuggagccccacaugcccgggagccugcgcacggccuucgugaccccgcccuccagcaccgccuccagccucgacaccgucuccacggugcccaagagcgugcuggacuccuggaccagcgccuucaacacccaccggcagccccuguucgcccaccuccgcaagcggggcgaguccaacgucuga

SEQ ID NO: 13215 - RNA, 780 nt, Artificial Sequence
  derived and/or modified sequence opt1 from capsid_protein_VP2__Norovirus__BAR42290
auggccggcgccuucaucgcggggcuggccggcgacaugcugaccagcuccguggggagccuggucaacgccggcgccaacgccaucaaccagaagaucgacuucgagaacaacaagcagcugcaguccgcgagcuuccagcacgacaaggagaugcuccaggcccaggugcgcgccaccaagcagcugcaguccgagaugaucgcccugaagcagggggugcucgcggccggcggcuucagccccacggacgccgcccggggguccaucggcgccccgaugaccaagguccuggacuggagcgggacccgcuacugggcgcccaacuccaccaagacgaccggcuacagcgggcaguucaccuccagccccgugcacauguccagccccaacgccccgcaguccaagcccgccaagccccggagccuggcccccuccagcuccagcagcuccguguacagcauguacacccaguccacgcaccucaccagcggcuccagcuccaacgccagcuccgcgagcaccaagcugaccucccugagcuccggcagcucccagaaccgcacggccgagugggucaaccagcagcggagccucuccccguucaugagcggggcccugaacaucucccacgugaccccgcccagcagccgcgccuccagcuccggcaccgugagcaccguccccaaggaggugcuggacuccuggacgagcgccuucaacacccaccggcagccccucuucgcgcaccuccgcgugcgcggggagucccgggucuga

SEQ ID NO: 13216 - RNA, 780 nt, Artificial Sequence
  derived and/or modified sequence opt1 from capsid_protein_VP2__Norovirus__BAR47617
auggccggcgccuucaucgcggggcuggccggcgacaugcugaccagcuccguggggagccuggucaacgccggcgccaacgccaucaaccagaagaucgacuucgagaacaacaagcagcugcaguccgcgagcuuccagcacgacaaggagaugcuccaggcccaggugaaggccaccaagcagcugcaguccgagaugaucgcccugaagcagggggugcucgcggccggcggcuucagccccacggacgccgcccgcggggccaucggcgcgccgaugaccaagguccuggacugguccgggacccgguacugggcccccaacagcaccaagacgaccggcuacuccgggcaguucaccagcucccccgugcacaugcccagcccgaacgcgccccaguccaagcccgccaagccccgcagccuggccccguccagcuccagcuccagcguguacagcauguccacccagagcacgcaccucaccuccggcagcuccagcaacgccuccagcgccuccaccaagcugaccaaccugagcuccggcagcucccagaaccggacggccgagugggucaaccagcagcgcagccucucccccuucaugagcggggcccugaacaucucccacgugaccccgcccagcucccgggccagcagcuccggcaccgugagcaccguccccaaggaggugcuggacuccuggacgagcgcguucaacacccaccgccagccccucuucgcccaccuccgggugcgcggggagucccgggucuga

SEQ ID NO: 13217 - RNA, 780 nt, Artificial Sequence
  derived and/or modified sequence opt1 from capsid_protein_VP2__Norovirus__BAR63716
auggccggcgccuucaucgcggggcuggccggcgacaugcugaccagcuccguggggagccuggucaacgccggcgccaacgccaucaaccagaagaucgacuucgagaacaacaagcagcugcaguccgcgagcuuccagcacgacaaggagaugcuccaggcccaggugaaggccaccaagcagcugcaguccgagaugaucgcccugaagcagggggugcucgcggccggcggcuucagccccacggacgccgcccgcggggccaucggcgcgccgaugaccaagguccuggacugguccgggacccgguacugggcccccaacagcaccaagacgaccggcuacuccgggcaguucaccagcucccccgugcgcaugcccagcccgaacgcgccccaguccaagcccgccaagccccggagccuggccccguccagcuccagcuccagcguguacagcauguccacccagagcacgcaccucaccuccggcagcuccagcaacgccuccagcgccuccaccaagcugaccaaccugagcuccggcagcucccagaaccgcacggccgagugggucaaccagcagcggagccucucccccuucaugagcggggcccugaacaucucccacgugaccccgcccagcucccgcgccagcagcuccggcaccgugagcaccguccccaaggaggugcuggacuccuggacgagcgcguucaacacccaccggcagccccucuucgcccaccuccgcgugcgcggggagucccgggucuga

SEQ ID NO: 13218 - RNA, 780 nt, Artificial Sequence; identical to SEQ ID NO: 13216
  derived and/or modified sequence opt1 from capsid_protein_VP2__Norovirus__BAR63719

SEQ ID NO: 13219 - RNA, 780 nt, Artificial Sequence; identical to SEQ ID NO: 13216
  derived and/or modified sequence opt1 from capsid_protein_VP2__Norovirus__BAR63722

SEQ ID NO: 13220 - RNA, 807 nt, Artificial Sequence
  derived and/or modified sequence opt1 from capsid_protein_VP2__Norovirus__BAS02084
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagcggcuccagcaggagaugaugaaggugaagcaggcgaugcugcuggagggcggguucuccgagaccgacgccgcccgcggcgccaucaacgcccccaugacgaaggcgcucgacuggaacgggacccgguacugggccccggacgcccgcaccaccacguacaacgccggccgguucagcacgccccagcccuccggggcccugcccggccgcgcgaaccugcgggacgccgugccggcccgcggcagcuccagcaaguccagcaacuccagcaccgccaccuccgucuacagcaaccagaccaucuccacccggcucgggagcaccgccggcagcgggaccuccgugagcuccuuccccagcacggcgcgcacccgguccuggguggaggaccagagccgcaaccugucccccuucaugcggggcgcccacaacaucagcuucgucacgcccccguccagccgcuccagcucccagggcaccgugagcaccgugccccgggagauccuggacuccuggaccggggccuucaacacccgccggcagccccucuucgcccacauccgcaagcggggcgagagccgcgucuga

SEQ ID NO: 13221 - RNA, 627 nt, Artificial Sequence
  derived and/or modified sequence opt1 from capsid_protein_VP2__Norovirus__CRL46953
auggcccaggccaucaucggcgcgaucgccgccagcgccgccggguccgcgcugggcgccgggauccaggccggcgccgaggcggcccuccaggcccagcgcuaccagcaggaccugacccugcagcagaacagcuucaaccacgacaaggagaugcucggguaccagguggagauguccaacaagcugcuggccaagaaccucaacacccgguacagccugcugcaggccggcggccucucccccagcgacgcggcccgcgccgucgccggggccccggugacgcggcugguggacuggggcgggguccgcguggcggcgccccaguccagcgccaccacccugcgguccggcaacuucauggccgugccccuccccgcccagccgaagcagaagccccuggccagcgagggguacuccaaccccgccuacgaccccaugcagcgcaccgccagcuggguccagucccagaacagcucccggaacuggagcccguaccaccgccaggcccugcagacggugugggugaccccgcccggcuccaccagcuccagcagcgucuccaccgcgccccggggcuacuucaacacggaccgccucccccuguucgccaaccugcggcgcuga

SEQ ID NO: 13222 - RNA, 630 nt, Artificial Sequence
  derived and/or modified sequence opt1 from capsid_protein_VP2__Norovirus__CRL46956
auggcccaggccgugaucggcgcgaucgccgccagcgccgccggguccauccugggcgcggggauccaggccggcgccgaggccgggcuccaggcgcagcgcuaccagcaggaccugcagcugcagcagaacagcuucaagcacgacaaggagaugcucggcuaccagguccaggccuccaacgcccugcuggccaagaaccucaacacccgguacgcccugcugcaggcgggcgggcucagcuccgccgacgccgcccgcgccguggcgggcgcccccgugacccggaucgucgacuggaacgggacgcgcaucgccgccccggccagcuccgcgaccacccugcggagcggcggguucauggccgugcccaucccccuguccagcaagaccaagcagcccgugauguccggccaggacaacccgaacuacgccgccagcuccaucagccgcacggccuccuggguccagagccagaacuccaugcggagcgugucccccuuccacagcgacgcgcuccgcaccgugugggucaccccgcccggcagcuccagcaccuccagcgugcaguccagcuucuacgggguguucaacacggaccggcugccccuguucgccaaccgccgguga

SEQ ID NO: 13223 - RNA, 807 nt, Artificial Sequence
  derived and/or modified sequence opt1 from capsid_protein_VP2__Norovirus__CRL46959
auggccggcgccuucuucgcggggcuggccagcgacgugcucggcuccgggcugagcucccugaucaacgccggcgccggggccaucaaccagaagaucgacuucgagaacaaccgcaagcuccagcaggcgagcuuccaguucuccagcaaccugcagcaggccuccuuccagcacgacaaggagaugcugcaggcccaggucgaggccaccaagaagcuccagcaggagaugaugaaggugaagcaggcgauccugcuggagggcggcuucagcgccaccgacgccgcccgcggggccaucaacgcgcccaugacgaaggugcucgacuggaacggcacccgguacugggccccggacgcccggaccaccacguacaacaccgggcacuucuccacgccccagagcuccggcgcccugcccgggcgcaccaacccccggaucccgacccccgcccgcgcgagcuccagcaccuccagcaacgccuccaccgccaccagcaucuccagcaaccagacggucagcacccggcugggcuccaccgccggcagcgggaccaacguguccagccuccccuccacggcccgcacccggagcuggguggaggaccagaaccgcaaccugucccccuucaugcggggcgcgcacaacaucagcuucgucaccccgcccuccagccgcuccagcucccaggggaccgugagcacggugcccaagggcguccuggacuccuggaccggcgccuucaacacccggcgccagccccucuucgccuacacccaccggcgcggggagagccggguguga

SEQ ID NO: 13224 - RNA, 807 nt, Artificial Sequence
  derived and/or modified sequence opt1 from capsid_protein_VP2__Norovirus__CRL46962
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggugaagcaggcgaugcugcuggagggcggguucuccgagaccgacgccgcccggggcgccaucaacgcccccaugacgaaggcgcucgacuggagcgggacccgcuacugggccccggacgcccggaccaccacguacaacgccggccgcuucuccacgccccagcccagcggggcccugcccggccgggcgaaccugcgcgacgccgugccggcccggggccccuccagcaaguucuccaacagcuccaccgccaccagcgucuacuccaaccagaccaucagcacccgccucggguccaccgccggcagcgggaccagcguguccagccugcccuccacggcgcggacccgcagcuggguggaggaccagucccggaaccugagccccuucaugggcggcgcccacaacaucuccuucgucaccccgcccagcucccgcagcuccagccaggggaccguguccacggugcccaaggagauccucgacagcuggaccggcgccuucaacacccggcgccagccccuguucgcccacauccggaagcgcggggagucccgggucuga

SEQ ID NO: 13225 - RNA, 807 nt, Artificial Sequence
  derived and/or modified sequence opt1 from capsid_protein_VP2__Norovirus__CRL46965
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccaaccugcagcaggccagcuuccagcacgacaaggagaugcugcaggcccagaucgaggccaccaagaagcuccagcaggagaugaugaaggugaagcaggcggugcugcuggagggcggguucuccgagaccgacgccgcccggggcgccaucaacgcccccaugacgaaggcgcucgacuggagcgggacccgcuacugggccccggacgcccggaccaccacguacaacgccggccgcuucuccacgccccagcccagcggggcccugcccggccgggcgaaccugcgcgacgccgccccggcccggggcuccagcuccaagagcuccaacagcuucaccgccaccuccgucuacagcaaccagaccaccuccacccgccucgggagcaccgcgggcagcgggacguccgugagcucccugcccagcaccgcccggacccgcuccuggguggaggaccagagccggaaccugucccccuucaugcgcggcgcccacaacaucagcuucgucacgcccccguccagccgguccagcucccagggcaccgugagcaccgugcccaaggagguccucgacuccuggaccggggccuucaacacccgccggcagccccuguucgcccacauccgccggcgcggcgagagccggguguga

SEQ ID NO: 13226 - RNA, 777 nt, Artificial Sequence
  derived and/or modified sequence opt1 from capsid_protein_VP2__Norovirus__CRL46968
auggccggcgccuuccuggcggggcucgugggcgacgccaucaccagcggggucggcucccugaucaacgccggggccaacgccaucaaccagaagguggaguacgacuucaacaagcagcugcagcucgcgagcuucaagcacgacaaggagaugcugcagucccaggugcuggccaccaagcagcuccagcaggagaugaugaacauccgccagggcguccugagcgccggcggguucucccccacggacgccgcgcggggcgccgugaacgccccgaugaccaagauccuggacuggaacgggacccgcuacuucgcccccaacagcaugaagaccacguccuacagcggccaguucuccagcaaccccgugcaccggcagcccaccuccccgcgcagcgacccgcccaagaucaaggucaacuccgacagcgccuccguguacagcuccgcgagcuccgcccccagccagagcacccacuccaccgcccucacggccgggagcuccagcucccggaccaccagcuccagcgccgcggccuccacccugagccgcacguccgacugggugcggggccagaacgagcgccugagccccuucauggacggcgcccuccagaccaccuucgucaccccgcccuccagcaaggccuccagcuacggguccgugagcacggugcccaaggccguccuggacuccuggacccccauguucaacacccaccggcagccccuguucgcgcacgugcgccggcgcggcgagagccagaucuga

SEQ ID NO: 13227 - RNA, 765 nt, Artificial Sequence
  derived and/or modified sequence opt1 from capsid_protein_VP2__Norovirus__CRL46971
auggccggcgccuucaucgcggggcuggccggcgacaugcugaccaacaccguggggagccuggucaacgccggcgccaacgccaucaaccagacgaucgaccuggagaacaacaaguaccuccagaacgcguccuucaaccacgacaaggagaugcugaacgcccagaucgaggccaccaagaagcugcaggccgacaugaucgcgaucaagcagggggugcucaccgccggcggcuucagccccaccgacgccgcccgcggggccaucaacgcgccgaugacgaaggugcuggacuggaacggcacccggcacugggcccccggggccaccuccaccacgagcauguccggcggguucacccaccagaccguccaccgcagcacccccaacuucaagacgaaccaggcccccaaguccaccccgagcuccggcagcuccgugcggagcaacuccacccagaucaccagccuguccagccacuccagcggcuccagccgcagcuccgggagcacggugauccgguccauccccagcuccgaccgcacccgggacugggucaaccagcagaacuucaaccucgagccccacaugcccggcagccugcgcaccgccuucgugaccccgcccuccagcacggcguccagcuccgggaccgugagcaccguccccaagaacgugcuggacuccuggaccagcgccuucaacacgcggcgccagccccucuucgcccaccuccggcgccggggcgaguccaacguguga

SEQ ID NO: 13228 - RNA, 771 nt, Artificial Sequence
  derived and/or modified sequence opt1 from capsid_protein_VP2__Norovirus__CRL46974
auggccggcgccuucguggcggggcuggccggcgacaucgucaccaacagcaucgggucccuggugaacgccggcgccaacgccaucaaccagaagguggacuucgagaacaacaagcagcugcagcaggcgagcuucaaccacgaccaggagaugcugcaggcccagauccaggccaccaagcagcuccaggccgacaugaucgcgcugcgccaggggguccugacggccggcggcuucucccccaccgacgccgcccgcggggccgugaacgcgccgaugacccaggugcucgacuggagcggcacccgguacugggcccccggggccacgaagaccaccgccuucuccggcggguucaccagcucccccaacacgcggaccaucguccccaagaagaccagcgccaccccggcguccacgagcgugucccgccccagcucccuggccagcaccgccuccacccggagcaccuucguguccggcacgagcucccugagcagcuccacccgcagcuccuucaacagccagcccaccuccagcuccagccggaccuccgaguggguccgcagccagaaccgggugcucgagcccuacaugcgcggcucccugcagacggccuucgugaccccgcccagcucccgggccagcuccaacgggaccgucagcaccgugcccaaggaggugcuggacuccuggacgagcgucuucaacacccaccgccagccccucuucgcgcaccuccggcgccggggcgagucccagguguga

SEQ ID NO: 13229 - RNA, 807 nt, Artificial Sequence
  derived and/or modified sequence opt1 from capsid_protein_VP2__Norovirus__CRL46977
auggccggcgccuucuucgcggggcuggccagcgacgugcucggcuccgggcugggcagccugaucaacgccggggccggcgccaucaaccagaaggucgaguucgagaacaaccgcaagcuccagcaggcguccuuccaguucagcuccagccugcagcaggccuccuuccagcacgacaaggagaugcugcaggcccagaucgaggccaccaagaagcuccagcaggagaugaugcgggugaagcaggcgaugcugcuggagggcggguucagcgagaccgacgccgcccgcggcgccaucaacgcccccaugacgaagacccucgacugguccgggacccgguacugggcgccggacgcccgcaccacgaccuacaacgccggccgguucagcacgccccagcccuccggggcccugcccggccgcgccaaccugcgggcgaccgccccggcccgcggcagcuccagcauguccagcaacuccagcaucgccaccuccguguacagcaaccagaccaccagcacccggcucggguccacggccggcagcgggaccuccgucagcucccugcccagcaccgcgcgcacccgguccuggguggaggaccagaaccgcaaccugagccccuucaugcggggcgcccacaacaucuccuucgugacgcccccgagcucccgcagcuccagccagggcaccgucuccaccgugcccaaggaggugcucgacagcuggaccggggccuucaacacgcggcgccagccccuguucgcccacauccggaagcgcggcgagucccgggccuga

SEQ ID NO: 13230 - RNA, 807 nt, Artificial Sequence
  derived and/or modified sequence opt1 from capsid_protein_VP2__Norovirus__CRL46980
auggccggcgccuuccuggcggggcucgccagcgacgugcugggcuccgggcugggcagccucaucaacgccggggccggcgccaucaaccagaaggucgaguucgagaacaaccgcaagcugcagcaggcguccuuccaguucagcuccagccugcagcaggccuccuuccagcacgacaaggagaugcuccaggcccagaucgaggccaccaagaagcugcagcaggagaugaugcgggugaagcaggcgaugcugcucgagggcggguucagcgagaccgacgccgcccgcggcgccaucaacgcccccaugacgaagacccuggacugguccgggacccgguacugggcgccggacgcccgcaccacgaccuacaacgccggccgguucagcacgccccagcccuccggggcccugcccggccgcgccaaccuccgggcgaccgccccggcccgcggcagcuccagcauguccagcaacuccagcaucgccaccuccguguacagcaaccagaccaccagcacccggcugggguccacggccggcagcgggaccuccgucagcucccugcccagcaccgcgcgcacccgguccuggguggaggaccagaaccgcaaccucagccccuucaugcggggcgcccacaacaucuccuucgugacgcccccgagcucccgcagcuccagccagggcaccgucuccaccgugcccaaggaggugcuggacagcuggaccggggccuucaacacgcggcgccagccccuguucgcccacauccggaagcgcggcgagucccgggccuga

SEQ ID NO: 13231 - RNA, 1623 nt, Artificial Sequence
  derived and/or modified sequence opt2 from capsid_protein_VP1__Norovirus__ABY65350
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguccuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccguccccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13232 - RNA, 1623 nt, Artificial Sequence
  derived and/or modified sequence opt2 from capsid_protein_VP1__Norovirus__ACO55068
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccgccgaggagauccccgccccccucggcacccccgacuucgucggccgcauccagggcguccucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13233 - RNA, 1623 nt, Artificial Sequence
  derived and/or modified sequence opt2 from capsid_protein_VP1__Norovirus__ADI45808
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccgcaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccucaucccccaggacuggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13234 - RNA, 1623 nt, Artificial Sequence
  derived and/or modified sequence opt2 from capsid_protein_VP1__Norovirus__ADI45811
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccccugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13235 - RNA, 1623 nt, Artificial Sequence
  derived and/or modified sequence opt2 from capsid_protein_VP1__Norovirus__ADI45812
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucacccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13236 - RNA, 1623 nt, Artificial Sequence
  derived and/or modified sequence opt2 from capsid_protein_VP1__Norovirus__ADI45814
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13237 - RNA, 1623 nt, Artificial Sequence
  derived and/or modified sequence opt2 from capsid_protein_VP1__Norovirus__ADI45815
augaagauggccuccuccgacgccaaccccuucgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13238 - RNA, 1623 nt, Artificial Sequence
  derived and/or modified sequence opt2 from capsid_protein_VP1__Norovirus__ADI45816
augaagauggccuccaacgacgccaaccccuccgacggcuccgccgccaaccucguccccgagaucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccccgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13239 - RNA, 1623 nt, Artificial Sequence
  derived and/or modified sequence opt2 from capsid_protein_VP1__Norovirus__ADI45817
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccccgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13240 - RNA, 1623 nt, Artificial Sequence
  derived and/or modified sequence opt2 from capsid_protein_VP1__Norovirus__ADI45818
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13241 - RNA, 1626 nt, Artificial Sequence
  derived and/or modified sequence opt2 from capsid_protein_VP1__Norovirus__AET79296
augcgcauguccgacggcgccgcccccaaggccaacggcuccgaggccuccggccaggaccucguccccaccgccgucgagcaggccguccccauccagcccgucgccggcgccucccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaaggccggcgacaagcucaaggucaccaccuucgagaugauccucggccccaccaccaacgucgaccaggcccccuaccagggccgcguccacgccuccaccuccgucaccgccucccucaaccucgucgacggccgcguccgcgccgucccccgcuccaucuacuccuuccaggacgucguccccgaguacaacgacggccuccucgucccccucgccccccccaucggccccuuccuccccggcgagguccuccuccgcuuccgcaccuacaugcgccagaucgacuccuccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 13242 - RNA, 1626 nt, Artificial Sequence
  derived and/or modified sequence opt2 from capsid_protein_VP1__Norovirus__AFB18026
augcgcauguccgacggcgccacccccaagcccaacggcuccgaggccgccggccaggaccucguccccuccuccgucgagcaggccauccccauccagcccgucgccggcgccgccgucgccgcccccaccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuucccccagggcucccucaccaccgcccagaucaccugcuucccccacgucaugugcgacguccgcacccucgagcccauccagcucccccuccucgacguccgccgcguccucuggcacgccacccagaaccaggaggaggccaugcgccucgucugcaugcucuacaccccccuccgcaccaacucccccggcgacgaguccuucgucgucuccggccgccuccucucccgccccucccccgacuucaacuucgucuaccucaccccccccaucgagcgcaccaucuaccgcauggucgaccuccccgucguccagccccgccucugcacccacucccgcuggcccgcccccgucuaccagauccucgucgaccccucccuccccuccaacccccaguggcagaacggccgcguccucaucgacggcacccuccucggcaccacccccaucuccuccuccugggucgccuccuucgccggcaccgccgaguacuccuuccaguccccccccuccgccgagaucggcgaggucucccucuucgagaucgacggcuccgccuacacccccggcgaccgcgccgccccccucggcuaccccgacuucuccggcacccucgaggucgagauccagaccgagaccaccaaggccggccagaagcucgacguccacaccuucaaccucgagcucaagucccagaccgucgaccaggcccccuuccagggcaaggucuacauggaccucgaggccuccgccucccucgaccucgucaacggccgcguccgcgccuccccccgcuccgucgccgccuucaaggacgagcuccccuccuacaacuccggccuccucgucccccucgcccccccccucggccccuuccuccccggcgagguccuccuccgcuuccgcaccuucgcccgccaggucgacaccaccgacgccuccgcccaggccgucgacugcgcccucccccaggagcucgucuccugguucgccuccuccaacuucaccguccaguccgaggcccuccuccuccgcuaccgcaacacccucaccggccagcuccucuucgagugcaagcucuacuccgagggcuacaucgcccucuccuacaccggcuccuccccccucaccuuccccaccgacggcuuccucgaggucgucuccugggucccccgccuccaccagcucgccuccgucggcucccucgccaccggccgcucccucaagcaguga

SEQ ID NO: 13243 - RNA, 1626 nt, Artificial Sequence
  derived and/or modified sequence opt2 from capsid_protein_VP1__Norovirus__AFB18027
augcgcauguccgacggcgccacccccaagcccaacggcuccgaggccgccggccaggaccucguccccuccuccgucgagcaggccauccccauccagcccgucgccggcgccgccgucgccgcccccaccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaggccaugcgccucgucugcaugcucuacaccccccuccgcaccaacucccccggcgacgaguccuucgucgucuccggccgccuccucucccgccccgccuccgacuucaacuucgucuaccucaccccccccaucgagcgcaccaucuaccgcauggucgaccuccccgucguccagccccgccucugcacccacucccgcuggcccgcccccgucuaccagauccucgucgaccccucccuccccuccaacccccaguggcagaacggccgcguccaggucgacggcacccuccucggcaccacccccgucuccggcuccugggucgccuccuucgccggcaccgccgaguacuccuuccagaccccccccuccgccgagaucggcaccaucucccucuucgagaucgacggcuccgccuacguccccggcgaccgcgccgccccccucggcuaccccgacuccgccggcacccucgaggucgagauccagaccgagaccaccaaggccggccagaagcucaacguccacaccuucucccucgagcucgucucccagaccgucgaccaggcccccuaccagggccagaucuucgucgaccucgagaccuccuccuccauggaccucgucaacggccgcguccgcgccuccccccgcuccaucuccggcuucaaggacgagcuccccuccuacaacaacggccuccucgucccccucgcccccccccucggccccuuccuccccggcgagguccuccuccgcuuccgcaccuucgccggccaggucgaccucaccgacgccgccgcccagcccgucgacugcgcccucccccaggaguucgucuccugguucgccuccaacaacuucaccguccaguccgaggcccuccuccuccgcuaccgcaacacccucaccggccagcuccucuucgagugcaagcucuacuccgagggcuacaucgcccucuccuacaccggcuccggcccccucaccuuccccaccgacggcuucuucgaggucgucuccugggucccccgccucuaccagcucgccuccgucggcucccucgccaccggccgcucccucaagcaguga

SEQ ID NO: 13244 - RNA, 1635 nt, Artificial Sequence
  derived and/or modified sequence opt2 from capsid_protein_VP1__Norovirus__AFI08231
augaugauggccuccaaggacgcccccaccaacauggacggcaccuccggcgccggccagcucguccccgaggccaacaccgccgagcccaucuccauggaccccgucgccggcgccgccaccgccgucgccaccgccggccagaucaacaugaucgaccccuggaucauguccaacuucguccaggccccccagggcgaguucaccgucucccccaacaacacccccggcgacguccucuucgaccuccagcucggcccccagcucaaccccuuccucgcccaccucgcccagauguacaacggcugggucggcaacaugcgcgucaagguccuccucgccggcaacgccuucaccgccggcaagaucaucaucuccugcaucccccccggcuucaccucccagaacaucuccaucgcccagaugaccauguucccccacgucaucgccgacguccgcguccucgagcccaucgagaucccccucgaggacguccgcaacguccucuuccacaccaacgacaaccgccccaccaugcgccucgucugcaugcucuacaccccccuccgcgccaacggcuccuccuccggcaccgaccccuucgucaucgccggccgcguccucaccugccccgacuccaacuucuccuuccucuuccucgucccccccaacgucgagcagaagacccgccccuucuccguccccaacaucccccucaacacccucuccaacucccgcguccccucccucaucaaguccaugaccaucucccgcgaccagaaccagaucauccaguuccagaacggccgcgucacccucgacggccagcuccagggcaccacccccaccuccgucucccagcucugcaagauccgcggcaccaccuaccacgccaccggcggcaacggcaucaaccucaccgagcucaacggcgagcccuaccacgccuucgagucccccgcccccaucggcuuccccgaccucggcggcugcgacuggcaccucaccgccacccccacccaggccuucaacgacggcgccaaggucguccgccucuccgucacccagggcgccgccuucgccccccaccucggcaccauccacuacaccaccaccgacaccgacuacaaccccaacaccuccaucaucugcacccucgacuggcucucccagaccgccggccaguccaacgucgaccccuggcagauccccaccuacggcuccacccucaccgaggccgcccagcucgccccccccaucuucccccccggcuucggcgagacccucgucuucuuccucuccgacuuccccaucuccaacggcaagaacggccucuccguccccugcacccucccccaggaguucgucacccacuucgucaacgagcaggcccccauccgcggcgaggccgcccuccuccacuacgucgaccccgacacccaccgcaaccucggcgaguucaagcucuaccccgagggcuucaugaccugcguccccaacaccuccggcggcggcccccagacccuccccaucaacggcgucuucgucuucgucuccugggucucccgcuucuaccagcucaagcccgucggcaccgccggcgccgcccgccgccucggcauccgccgcuccuga

SEQ ID NO: 13245 - RNA, 1623 nt, Artificial Sequence
  derived and/or modified sequence opt2 from capsid_protein_VP1__Norovirus__AFI08240
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13246 - RNA, 1620 nt, Artificial Sequence
  derived and/or modified sequence opt2 from capsid_protein_VP1__Norovirus__AFS33552
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagucccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgccucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcgcccucuga

SEQ ID NO: 13247 - RNA, 1608 nt, Artificial Sequence
  derived and/or modified sequence opt2 from capsid_protein_VP1__Norovirus__AFS33555
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagauccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuucccccucgagaaccucucccccggccagaucaccauguucccccacgucaucaucgacguccgcacccucgagcccguccuccucccccuccccgacguccgcaacaacuucuuccacuacaaccagcagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccguccccaucgacgagcucuacaccucccccaacgagggcgucaucguccagccccagaacggccgcuccacccucgacggcgagcuccucggcaccacccagcucguccccuccaacaucugcgcccuccgcggccgcaucaacgcccagguccccgacgaccaccaccaguggaaccuccaggucaccaacaccaacggcacccccuucgaccccaccgaggacguccccgccccccucggcacccccgacuuccucgccaacaucuacggcgucaccucccagcgcaaccccaacaacaccugccgcgcccacgacggcguccucgccaccuggucccccaaguucacccccaagcucggcuccgucauccucggcaccugggaggaguccgaccucgaccucaaccagcccacccgcuucacccccgucggccucuucaacaccgaccacuucgaccagugggcccuccccuccuacuccggccgccucacccucaacaugaaccucgcccccuccgucuccccccucuuccccggcgagcagcuccucuucuuccgcucccacaucccccucaagggcggcaccuccgacggcgccaucgacugccuccucccccaggaguggauccagcacuucuaccaggaguccgcccccucccccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 13248 - RNA, 1623 nt, Artificial Sequence
  derived and/or modified sequence opt2 from capsid_protein_VP1__Norovirus__AFW15938
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacgcccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13249 - RNA, 1623 nt, Artificial Sequence
  derived and/or modified sequence opt2 from capsid_protein_VP1__Norovirus__AFW15940
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgaguccaagaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacgcccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13250 - RNA, 1623 nt, Artificial Sequence
  derived and/or modified sequence opt2 from capsid_protein_VP1__Norovirus__AFW15941
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13251 - RNA, 1623 nt, Artificial Sequence
  derived and/or modified sequence opt2 from capsid_protein_VP1__Norovirus__AFW15944
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacugguccuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13252 - RNA, 1623 nt, Artificial Sequence
  derived and/or modified sequence opt2 from capsid_protein_VP1__Norovirus__AFW15947
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13253 - RNA, 1623 nt, Artificial Sequence
  derived and/or modified sequence opt2 from capsid_protein_VP1__Norovirus__AFW15948
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13254 - RNA, 1623 nt, Artificial Sequence; identical to SEQ ID NO: 13252
  derived and/or modified sequence opt2 from capsid_protein_VP1__Norovirus__AFW15949

SEQ ID NO: 13255 - RNA, 1623 nt, Artificial Sequence
  derived and/or modified sequence opt2 from capsid_protein_VP1__Norovirus__AFW15950
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacgucugcaccuuccgcggcgacgucacccacaucuccggcucccgcaacuacaccaugaaccucgccucccagaacuggaccuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13256 - RNA, 1623 nt, Artificial Sequence
  derived and/or modified sequence opt2 from capsid_protein_VP1__Norovirus__AFW15951
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaccuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13257 - RNA, 1653 nt, Artificial Sequence
  derived and/or modified sequence opt2 from capsid_protein_VP1__Norovirus__AFX71665
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcaaccacccccuccacguccaggucaagaaccucgacggcacccaguacgaccccaccgacgacauccccgccguccucggcgccaucgacuuccagggcaccgucuucggcgucgccucccagcgcgacgucuccggccagcaggagcagggccacuacgccacccgcgcccacgaggcccacaucgacaccaccgaccccaaguacgcccccaagcucggcaccauccucaucaaguccgacuccgacgacuucaacaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 13258 - RNA, 1623 nt, Artificial Sequence
  derived and/or modified sequence opt2 from capsid_protein_VP1__Norovirus__AFX71668
augaagauggccuccuccgacgccucccccuccgacggcuccaccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcaacaccaccccccgcaacgagccccagcaguggguccuccccuccuacuccggccgcaacauccagaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13259 - RNA, 1623 nt, Artificial Sequence; identical to SEQ ID NO: 13245
  derived and/or modified sequence opt2 from capsid_protein_VP1__Norovirus__AFX81121

SEQ ID NO: 13260 - RNA, 1623 nt, Artificial Sequence; identical to SEQ ID NO: 13245
  derived and/or modified sequence opt2 from capsid_protein_VP1__Norovirus__AFX81127

SEQ ID NO: 13261 - RNA, 1623 nt, Artificial Sequence; identical to SEQ ID NO: 13245
  derived and/or modified sequence opt2 from capsid_protein_VP1__Norovirus__AFX81130

SEQ ID NO: 13262 - RNA, 1623 nt, Artificial Sequence; identical to SEQ ID NO: 13245
  derived and/or modified sequence opt2 from capsid_protein_VP1__Norovirus__AFX81136

SEQ ID NO: 13263 - RNA, 1623 nt, Artificial Sequence; identical to SEQ ID NO: 13245
  derived and/or modified sequence opt2 from capsid_protein_VP1__Norovirus__AFX81139

SEQ ID NO: 13264 - RNA, 1623 nt, Artificial Sequence; identical to SEQ ID NO: 13245
  derived and/or modified sequence opt2 from capsid_protein_VP1__Norovirus__AFX81142

SEQ ID NO: 13265 - RNA, 1623 nt, Artificial Sequence; identical to SEQ ID NO: 13245
  derived and/or modified sequence opt2 from capsid_protein_VP1__Norovirus__AFX81145

SEQ ID NO: 13266 - RNA, 1623 nt, Artificial Sequence; identical to SEQ ID NO: 13245
  derived and/or modified sequence opt2 from capsid_protein_VP1__Norovirus__AFX81148

SEQ ID NO: 13267 - RNA, 1623 nt, Artificial Sequence; identical to SEQ ID NO: 13245
  derived and/or modified sequence opt2 from capsid_protein_VP1__Norovirus__AFX81154

SEQ ID NO: 13268 - RNA, 1623 nt, Artificial Sequence; identical to SEQ ID NO: 13245
  derived and/or modified sequence opt2 from capsid_protein_VP1__Norovirus__AFX81157

SEQ ID NO: 13269 - RNA, 1623 nt, Artificial Sequence; identical to SEQ ID NO: 13245
  derived and/or modified sequence opt2 from capsid_protein_VP1__Norovirus__AFX81163

SEQ ID NO: 13270 - RNA, 1623 nt, Artificial Sequence
  derived and/or modified sequence opt2 from capsid_protein_VP1__Norovirus__AFX81166
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13271 - RNA, 1623 nt, Artificial Sequence; identical to SEQ ID NO: 13245
  derived and/or modified sequence opt2 from capsid_protein_VP1__Norovirus__AFX81169

SEQ ID NO: 13272 - RNA, 1623 nt, Artificial Sequence; identical to SEQ ID NO: 13245
  derived and/or modified sequence opt2 from capsid_protein_VP1__Norovirus__AFX81172

SEQ ID NO: 13273 - RNA, 1623 nt, Artificial Sequence; identical to SEQ ID NO: 13245
  derived and/or modified sequence opt2 from capsid_protein_VP1__Norovirus__AFX81178

SEQ ID NO: 13274 - RNA, 1623 nt, Artificial Sequence; identical to SEQ ID NO: 13245
  derived and/or modified sequence opt2 from capsid_protein_VP1__Norovirus__AFX81181

SEQ ID NO: 13275 - RNA, 1623 nt, Artificial Sequence; identical to SEQ ID NO: 13245
  derived and/or modified sequence opt2 from capsid_protein_VP1__Norovirus__AFX81190

SEQ ID NO: 13276 - RNA, 1623 nt, Artificial Sequence; identical to SEQ ID NO: 13245
  derived and/or modified sequence opt2 from capsid_protein_VP1__Norovirus__AFX81193

SEQ ID NO: 13277 - RNA, 1623 nt, Artificial Sequence; identical to SEQ ID NO: 13245
  derived and/or modified sequence opt2 from capsid_protein_VP1__Norovirus__AFX81196

SEQ ID NO: 13278 - RNA, 1623 nt, Artificial Sequence
  derived and/or modified sequence opt2 from capsid_protein_VP1__Norovirus__AFX81199
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13279 - RNA, 1623 nt, Artificial Sequence; identical to SEQ ID NO: 13245
  derived and/or modified sequence opt2 from capsid_protein_VP1__Norovirus__AFX81202

SEQ ID NO: 13280 - RNA, 1623 nt, Artificial Sequence
  derived and/or modified sequence opt2 from capsid_protein_VP1__Norovirus__AFX81205
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcagugggcccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13281 - RNA, 1623 nt, Artificial Sequence; identical to SEQ ID NO: 13245
  derived and/or modified sequence opt2 from capsid_protein_VP1__Norovirus__AFX81208

SEQ ID NO: 13282 - RNA, 1623 nt, Artificial Sequence; identical to SEQ ID NO: 13245
  derived and/or modified sequence opt2 from capsid_protein_VP1__Norovirus__AFX81211

SEQ ID NO: 13283 - RNA, 1623 nt, Artificial Sequence; identical to SEQ ID NO: 13245
  derived and/or modified sequence opt2 from capsid_protein_VP1__Norovirus__AFX81214

SEQ ID NO: 13284 - RNA, 1623 nt, Artificial Sequence; identical to SEQ ID NO: 13245
  derived and/or modified sequence opt2 from capsid_protein_VP1__Norovirus__AFX81226

SEQ ID NO: 13285 - RNA, 1623 nt, Artificial Sequence
  derived and/or modified sequence opt2 from capsid_protein_VP1__Norovirus__AFX81229
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugucccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13286 - RNA, 1623 nt, Artificial Sequence; identical to SEQ ID NO: 13245
  derived and/or modified sequence opt2 from capsid_protein_VP1__Norovirus__AFX81232

SEQ ID NO: 13287 - RNA, 1623 nt, Artificial Sequence; identical to SEQ ID NO: 13245
  derived and/or modified sequence opt2 from capsid_protein_VP1__Norovirus__AFX81238

SEQ ID NO: 13288 - RNA, 1623 nt, Artificial Sequence
  derived and/or modified sequence opt2 from capsid_protein_VP1__Norovirus__AFX81241
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13289 - RNA, 1623 nt, Artificial Sequence
  derived and/or modified sequence opt2 from capsid_protein_VP1__Norovirus__AFX81247
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacugggacuccuacgaccccaccgaggagacccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13290 - RNA, 1623 nt, Artificial Sequence
  derived and/or modified sequence opt2 from capsid_protein_VP1__Norovirus__AFX81250
augaagauggccuccuccgacgccaaccccuccaacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccuccucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuuccagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13291 - RNA, 1623 nt, Artificial Sequence; identical to SEQ ID NO: 13288
  derived and/or modified sequence opt2 from capsid_protein_VP1__Norovirus__AFX81253

SEQ ID NO: 13292 - RNA, 1623 nt, Artificial Sequence
  derived and/or modified sequence opt2 from capsid_protein_VP1__Norovirus__AFX81256
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13293 - RNA, 1623 nt, Artificial Sequence; identical to SEQ ID NO: 13245
  derived and/or modified sequence opt2 from capsid_protein_VP1__Norovirus__AFX81262

SEQ ID NO: 13294 - RNA, 1623 nt, Artificial Sequence; identical to SEQ ID NO: 13245
  derived and/or modified sequence opt2 from capsid_protein_VP1__Norovirus__AFX81265

SEQ ID NO: 13295 - RNA, 1623 nt, Artificial Sequence
  derived and/or modified sequence opt2 from capsid_protein_VP1__Norovirus__AFX81268
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccgcgucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13296 - RNA, 1623 nt, Artificial Sequence; identical to SEQ ID NO: 13245
  derived and/or modified sequence opt2 from capsid_protein_VP1__Norovirus__AFX81271

SEQ ID NO: 13297 - RNA, 1623 nt, Artificial Sequence
  derived and/or modified sequence opt2 from capsid_protein_VP1__Norovirus__AFX81274
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccgcgucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucuccaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13298 - RNA, 1623 nt, Artificial Sequence; identical to SEQ ID NO: 13295
  derived and/or modified sequence opt2 from capsid_protein_VP1__Norovirus__AFX81277

SEQ ID NO: 13299 - RNA, 1623 nt, Artificial Sequence
  derived and/or modified sequence opt2 from capsid_protein_VP1__Norovirus__AFX81283
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13300 - RNA, 1623 nt, Artificial Sequence; identical to SEQ ID NO: 13245
  derived and/or modified sequence opt2 from capsid_protein_VP1__Norovirus__AFX81289

SEQ ID NO: 13301 - RNA, 1623 nt, Artificial Sequence; identical to SEQ ID NO: 13245
  derived and/or modified sequence opt2 from capsid_protein_VP1__Norovirus__AFX81292

SEQ ID NO: 13302 - RNA, 1623 nt, Artificial Sequence; identical to SEQ ID NO: 13245
  derived and/or modified sequence opt2 from capsid_protein_VP1__Norovirus__AFX81295

SEQ ID NO: 13303 - RNA, 1623 nt, Artificial Sequence; identical to SEQ ID NO: 13245
  derived and/or modified sequence opt2 from capsid_protein_VP1__Norovirus__AFX81298

SEQ ID NO: 13304 - RNA, 1623 nt, Artificial Sequence
  derived and/or modified sequence opt2 from capsid_protein_VP1__Norovirus__AFX81301
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13305 - RNA, 1623 nt, Artificial Sequence; identical to SEQ ID NO: 13245
  derived and/or modified sequence opt2 from capsid_protein_VP1__Norovirus__AFX81304

SEQ ID NO: 13306 - RNA, 1623 nt, Artificial Sequence; identical to SEQ ID NO: 13245
  derived and/or modified sequence opt2 from capsid_protein_VP1__Norovirus__AFX81307

SEQ ID NO: 13307 - RNA, 1623 nt, Artificial Sequence; identical to SEQ ID NO: 13245
  derived and/or modified sequence opt2 from capsid_protein_VP1__Norovirus__AFX81313

SEQ ID NO: 13308 - RNA, 1623 nt, Artificial Sequence; identical to SEQ ID NO: 13245
  derived and/or modified sequence opt2 from capsid_protein_VP1__Norovirus__AFX81316

SEQ ID NO: 13309 - RNA, 1623 nt, Artificial Sequence; identical to SEQ ID NO: 13245
  derived and/or modified sequence opt2 from capsid_protein_VP1__Norovirus__AFX81319

SEQ ID NO: 13310 - RNA, 1623 nt, Artificial Sequence; identical to SEQ ID NO: 13245
  derived and/or modified sequence opt2 from capsid_protein_VP1__Norovirus__AFX81322

SEQ ID NO: 13311 - RNA, 1623 nt, Artificial Sequence; identical to SEQ ID NO: 13245
  derived and/or modified sequence opt2 from capsid_protein_VP1__Norovirus__AFX81325

SEQ ID NO: 13312 - RNA, 1623 nt, Artificial Sequence; identical to SEQ ID NO: 13245
  derived and/or modified sequence opt2 from capsid_protein_VP1__Norovirus__AGE89433

SEQ ID NO: 13313 - RNA, 1623 nt, Artificial Sequence; identical to SEQ ID NO: 13245
  derived and/or modified sequence opt2 from capsid_protein_VP1__Norovirus__AGE89436

SEQ ID NO: 13314 - RNA, 1623 nt, Artificial Sequence; identical to SEQ ID NO: 13292
  derived and/or modified sequence opt2 from capsid_protein_VP1__Norovirus__AGE89439

SEQ ID NO: 13315 - RNA, 1623 nt, Artificial Sequence
  derived and/or modified sequence opt2 from capsid_protein_VP1__Norovirus__AGE89442
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13316 - RNA, 1623 nt, Artificial Sequence
  derived and/or modified sequence opt2 from capsid_protein_VP1__Norovirus__AGE89445
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13317 - RNA, 1623 nt, Artificial Sequence; identical to SEQ ID NO: 13292
  derived and/or modified sequence opt2 from capsid_protein_VP1__Norovirus__AGE89448

SEQ ID NO: 13318 - RNA, 1623 nt, Artificial Sequence; identical to SEQ ID NO: 13245
  derived and/or modified sequence opt2 from capsid_protein_VP1__Norovirus__AGE89451

SEQ ID NO: 13319 - RNA, 1623 nt, Artificial Sequence
  derived and/or modified sequence opt2 from capsid_protein_VP1__Norovirus__AGE89454
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggggcgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaacggccagcacgaccucgucaucccccccaacggcuacuuccgcuucgacuccugggucaaccaguucuacacccucgcccccaugggcaacggcaccggccgccgccgcgcccucuga

SEQ ID NO: 13320 - RNA, 1623 nt, Artificial Sequence; identical to SEQ ID NO: 13245
  derived and/or modified sequence opt2 from capsid_protein_VP1__Norovirus__AGE89457

SEQ ID NO: 13321 - RNA, 1623 nt, Artificial Sequence; identical to SEQ ID NO: 13245
  derived and/or modified sequence opt2 from capsid_protein_VP1__Norovirus__AGE89460

SEQ ID NO: 13322 - RNA, 1623 nt, Artificial Sequence; identical to SEQ ID NO: 13245
  derived and/or modified sequence opt2 from capsid_protein_VP1__Norovirus__AGE89463

SEQ ID NO: 13323 - RNA, 1623 nt, Artificial Sequence; identical to SEQ ID NO: 13245
  derived and/or modified sequence opt2 from capsid_protein_VP1__Norovirus__AGE89466

SEQ ID NO: 13324 - RNA, 1623 nt, Artificial Sequence; identical to SEQ ID NO: 13319
  derived and/or modified sequence opt2 from capsid_protein_VP1__Norovirus__AGE89472

SEQ ID NO: 13325 - RNA, 1623 nt, Artificial Sequence; identical to SEQ ID NO: 13295
  derived and/or modified sequence opt2 from capsid_protein_VP1__Norovirus__AGE89475

SEQ ID NO: 13326 - RNA, 1623 nt, Artificial Sequence; identical to SEQ ID NO: 13245
  derived and/or modified sequence opt2 from capsid_protein_VP1__Norovirus__AGE89478

SEQ ID NO: 13327 - RNA, 1623 nt, Artificial Sequence
  derived and/or modified sequence opt2 from capsid_protein_VP1__Norovirus__AGE89481
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13328 - RNA, 1623 nt, Artificial Sequence; identical to SEQ ID NO: 13245
  derived and/or modified sequence opt2 from capsid_protein_VP1__Norovirus__AGE89490

SEQ ID NO: 13329 - RNA, 1623 nt, Artificial Sequence; identical to SEQ ID NO: 13245
  derived and/or modified sequence opt2 from capsid_protein_VP1__Norovirus__AGE89493

SEQ ID NO: 13330 - RNA, 1623 nt, Artificial Sequence
  derived and/or modified sequence opt2 from capsid_protein_VP1__Norovirus__AGE89496
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13331 - RNA, 1623 nt, Artificial Sequence; identical to SEQ ID NO: 13245
  derived and/or modified sequence opt2 from capsid_protein_VP1__Norovirus__AGE89499

SEQ ID NO: 13332 - RNA, 1623 nt, Artificial Sequence
  derived and/or modified sequence opt2 from capsid_protein_VP1__Norovirus__AGE89502
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcgccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13333 - RNA, 1623 nt, Artificial Sequence; identical to SEQ ID NO: 13245
  derived and/or modified sequence opt2 from capsid_protein_VP1__Norovirus__AGE89505

SEQ ID NO: 13334 - RNA, 1623 nt, Artificial Sequence
  derived and/or modified sequence opt2 from capsid_protein_VP1__Norovirus__AGE89508
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13335 - RNA, 1623 nt, Artificial Sequence; identical to SEQ ID NO: 13245
  derived and/or modified sequence opt2 from capsid_protein_VP1__Norovirus__AGE89511

SEQ ID NO: 13336 - RNA, 1623 nt, Artificial Sequence; identical to SEQ ID NO: 13245
  derived and/or modified sequence opt2 from capsid_protein_VP1__Norovirus__AGE89514

SEQ ID NO: 13337 - RNA, 1623 nt, Artificial Sequence; identical to SEQ ID NO: 13245
  derived and/or modified sequence opt2 from capsid_protein_VP1__Norovirus__AGE89517

SEQ ID NO: 13338 - RNA, 1623 nt, Artificial Sequence; identical to SEQ ID NO: 13332
  derived and/or modified sequence opt2 from capsid_protein_VP1__Norovirus__AGE89520

SEQ ID NO: 13339 - RNA, 1623 nt, Artificial Sequence; identical to SEQ ID NO: 13245
  derived and/or modified sequence opt2 from capsid_protein_VP1__Norovirus__AGE89523

SEQ ID NO: 13340 - RNA, 1623 nt, Artificial Sequence; identical to SEQ ID NO: 13245
  derived and/or modified sequence opt2 from capsid_protein_VP1__Norovirus__AGE89526

SEQ ID NO: 13341 - RNA, 1623 nt, Artificial Sequence; identical to SEQ ID NO: 13327
  derived and/or modified sequence opt2 from capsid_protein_VP1__Norovirus__AGE89529

SEQ ID NO: 13342 - RNA, 1623 nt, Artificial Sequence; identical to SEQ ID NO: 13245
  derived and/or modified sequence opt2 from capsid_protein_VP1__Norovirus__AGE89532

SEQ ID NO: 13343 - RNA, 1623 nt, Artificial Sequence; identical to SEQ ID NO: 13295
  derived and/or modified sequence opt2 from capsid_protein_VP1__Norovirus__AGE89535

SEQ ID NO: 13344 - RNA, 1623 nt, Artificial Sequence
  derived and/or modified sequence opt2 from capsid_protein_VP1__Norovirus__AGE89538
augaagauggccuccaacgacgccaaccccuccgacggcuccgccgccucccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgccgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13345 - RNA, 1623 nt, Artificial Sequence; identical to SEQ ID NO: 13245
  derived and/or modified sequence opt2 from capsid_protein_VP1__Norovirus__AGE89541

SEQ ID NO: 13346 - RNA, 1623 nt, Artificial Sequence; identical to SEQ ID NO: 13245
  derived and/or modified sequence opt2 from capsid_protein_VP1__Norovirus__AGE89544

SEQ ID NO: 13347 - RNA, 1623 nt, Artificial Sequence; identical to SEQ ID NO: 13299
  derived and/or modified sequence opt2 from capsid_protein_VP1__Norovirus__AGE89547

SEQ ID NO: 13348 - RNA, 1623 nt, Artificial Sequence; identical to SEQ ID NO: 13278
  derived and/or modified sequence opt2 from capsid_protein_VP1__Norovirus__AGE89550

SEQ ID NO: 13349 - RNA, 1623 nt, Artificial Sequence
  derived and/or modified sequence opt2 from capsid_protein_VP1__Norovirus__AGE89553
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13350 - RNA, 1623 nt, Artificial Sequence; identical to SEQ ID NO: 13327
  derived and/or modified sequence opt2 from capsid_protein_VP1__Norovirus__AGE89556

SEQ ID NO: 13351 - RNA, 1623 nt, Artificial Sequence
  derived and/or modified sequence opt2 from capsid_protein_VP1__Norovirus__AGE89559
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaaggaggacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagauccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13352 - RNA, 1623 nt, Artificial Sequence
  derived and/or modified sequence opt2 from capsid_protein_VP1__Norovirus__AGE89562
augaagauggccuccaacgacgccaaccccuccgacggcuccgccgccucccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13353 - RNA, 1623 nt, Artificial Sequence
  derived and/or modified sequence opt2 from capsid_protein_VP1__Norovirus__AGE89565
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagacccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13354 - RNA, 1623 nt, Artificial Sequence; identical to SEQ ID NO: 13245
  derived and/or modified sequence opt2 from capsid_protein_VP1__Norovirus__AGE89568

SEQ ID NO: 13355 - RNA, 1623 nt, Artificial Sequence; identical to SEQ ID NO: 13245
  derived and/or modified sequence opt2 from capsid_protein_VP1__Norovirus__AGE89571

SEQ ID NO: 13356 - RNA, 1623 nt, Artificial Sequence; identical to SEQ ID NO: 13245
  derived and/or modified sequence opt2 from capsid_protein_VP1__Norovirus__AGE89574

SEQ ID NO: 13357 - RNA, 1623 nt, Artificial Sequence; identical to SEQ ID NO: 13245
  derived and/or modified sequence opt2 from capsid_protein_VP1__Norovirus__AGE89577

SEQ ID NO: 13358 - RNA, 1623 nt, Artificial Sequence; identical to SEQ ID NO: 13278
  derived and/or modified sequence opt2 from capsid_protein_VP1__Norovirus__AGE89580

SEQ ID NO: 13359 - RNA, 1623 nt, Artificial Sequence; identical to SEQ ID NO: 13245
  derived and/or modified sequence opt2 from capsid_protein_VP1__Norovirus__AGE89583

SEQ ID NO: 13360 - RNA, 1623 nt, Artificial Sequence
  derived and/or modified sequence opt2 from capsid_protein_VP1__Norovirus__AGE89586
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13361 - RNA, 1623 nt, Artificial Sequence; identical to SEQ ID NO: 13245
  derived and/or modified sequence opt2 from capsid_protein_VP1__Norovirus__AGE89589

SEQ ID NO: 13362 - RNA, 1623 nt, Artificial Sequence; identical to SEQ ID NO: 13245
  derived and/or modified sequence opt2 from capsid_protein_VP1__Norovirus__AGE89592

SEQ ID NO: 13363 - RNA, 1623 nt, Artificial Sequence; identical to SEQ ID NO: 13292
  derived and/or modified sequence opt2 from capsid_protein_VP1__Norovirus__AGE89595

SEQ ID NO: 13364 - RNA, 1623 nt, Artificial Sequence
  derived and/or modified sequence opt2 from capsid_protein_VP1__Norovirus__AGE89598
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13365 - RNA, 1623 nt, Artificial Sequence; identical to SEQ ID NO: 13245
  derived and/or modified sequence opt2 from capsid_protein_VP1__Norovirus__AGE89601

SEQ ID NO: 13366 - RNA, 1623 nt, Artificial Sequence; identical to SEQ ID NO: 13245
  derived and/or modified sequence opt2 from capsid_protein_VP1__Norovirus__AGE89604

SEQ ID NO: 13367 - RNA, 1623 nt, Artificial Sequence; identical to SEQ ID NO: 13245
  derived and/or modified sequence opt2 from capsid_protein_VP1__Norovirus__AGE89607

SEQ ID NO: 13368 - RNA, 1623 nt, Artificial Sequence; identical to SEQ ID NO: 13245
  derived and/or modified sequence opt2 from capsid_protein_VP1__Norovirus__AGE89610

SEQ ID NO: 13369 - RNA, 1623 nt, Artificial Sequence; identical to SEQ ID NO: 13278
  derived and/or modified sequence opt2 from capsid_protein_VP1__Norovirus__AGE89613

SEQ ID NO: 13370 - RNA, 1623 nt, Artificial Sequence
  derived and/or modified sequence opt2 from capsid_protein_VP1__Norovirus__AGE89616
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13371 - RNA, 1623 nt, Artificial Sequence; identical to SEQ ID NO: 13292
  derived and/or modified sequence opt2 from capsid_protein_VP1__Norovirus__AGE89622

SEQ ID NO: 13372 - RNA, 1623 nt, Artificial Sequence
  derived and/or modified sequence opt2 from capsid_protein_VP1__Norovirus__AGE89625
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaucaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13373 - RNA, 1623 nt, Artificial Sequence
  derived and/or modified sequence opt2 from capsid_protein_VP1__Norovirus__AGE89628
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13374 - RNA, 1623 nt, Artificial Sequence; identical to SEQ ID NO: 13245
  derived and/or modified sequence opt2 from capsid_protein_VP1__Norovirus__AGE89631

SEQ ID NO: 13375 - RNA, 1623 nt, Artificial Sequence; identical to SEQ ID NO: 13299
  derived and/or modified sequence opt2 from capsid_protein_VP1__Norovirus__AGE89634

SEQ ID NO: 13376 - RNA, 1623 nt, Artificial Sequence; identical to SEQ ID NO: 13245
  derived and/or modified sequence opt2 from capsid_protein_VP1__Norovirus__AGE89637

SEQ ID NO: 13377 - RNA, 1623 nt, Artificial Sequence; identical to SEQ ID NO: 13245
  derived and/or modified sequence opt2 from capsid_protein_VP1__Norovirus__AGE89640

SEQ ID NO: 13378 - RNA, 1623 nt, Artificial Sequence
  derived and/or modified sequence opt2 from capsid_protein_VP1__Norovirus__AGE89643
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggaugcuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13379 - RNA, 1623 nt, Artificial Sequence; identical to SEQ ID NO: 13245
  derived and/or modified sequence opt2 from capsid_protein_VP1__Norovirus__AGE89646

SEQ ID NO: 13380 - RNA, 1623 nt, Artificial Sequence
  derived and/or modified sequence opt2 from capsid_protein_VP1__Norovirus__AGE89649
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13381 - RNA, 1623 nt, Artificial Sequence
  derived and/or modified sequence opt2 from capsid_protein_VP1__Norovirus__AGE89652
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccaacaacgaccucggcgccaaccagaacaccaaguucacccccgucggcgucauccaggacggcggcaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13382 - RNA, 1623 nt, Artificial Sequence; identical to SEQ ID NO: 13245
  derived and/or modified sequence opt2 from capsid_protein_VP1__Norovirus__AGE89655

SEQ ID NO: 13383 - RNA, 1623 nt, Artificial Sequence; identical to SEQ ID NO: 13245
  derived and/or modified sequence opt2 from capsid_protein_VP1__Norovirus__AGE89658

SEQ ID NO: 13384 - RNA, 1623 nt, Artificial Sequence; identical to SEQ ID NO: 13245
  derived and/or modified sequence opt2 from capsid_protein_VP1__Norovirus__AGE89661

SEQ ID NO: 13385 - RNA, 1623 nt, Artificial Sequence
  derived and/or modified sequence opt2 from capsid_protein_VP1__Norovirus__AGE89664
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgaggacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13386 - RNA, 1623 nt, Artificial Sequence; identical to SEQ ID NO: 13245
  derived and/or modified sequence opt2 from capsid_protein_VP1__Norovirus__AGE89667

SEQ ID NO: 13387 - RNA, 1623 nt, Artificial Sequence; identical to SEQ ID NO: 13245
  derived and/or modified sequence opt2 from capsid_protein_VP1__Norovirus__AGE89673

SEQ ID NO: 13388 - RNA, 1623 nt, Artificial Sequence
  derived and/or modified sequence opt2 from capsid_protein_VP1__Norovirus__AGE99603
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaugauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgacaacgacuucgagacccaccagaacacccgcuucacccccgucggcgucauccaggacggcgccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13389 - RNA, 1623 nt, Artificial Sequence
  derived and/or modified sequence opt2 from capsid_protein_VP1__Norovirus__AGI17592
augaugauggccuccaacgacgccgcccccuccaacgacggcgccaccggccucguccccgagaucaaccacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccgccaaccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucaccaucuccgagcucaccaacucccgcuuccccgcccccaucgacucccucuacaccgcccagaacaacaaccucaacguccagugccagaacggccgcugcacccucgacggcgagcuccagggcaccacccagcuccuccccuccggcaucugcgccuuccgcggcaagcucaccgccgacguccaccagucccacgacgaccgcuggcacaugcagcucaccaaccucaacggcacccccuucgaccccaccgaggacguccccgccccccucggcacccccgacuucaccggccuccucuucggcgucgccucccagcgcaacgucgucuccaaccccaacaccacccgcgcccacgaggccgucaucuccaccaccuccucccaguucguccccaagcucggcuccaucaacuucggcuccaccuccgacgacuuccagcuccagcagcccaccaaguucacccccgucggcaucaaggucgaguccggccacgacuucgaccagugggcccucccccgcuacuccggccaccucacccucaacaugaaccucgccccccccgucgcccccaacuuccccggcgagcagcuccucuucuuccgcuccaacguccccugcgccggcggcgucuccgacggcgucaucgacugccuccucccccaggaguggauccaguacuucuaccaggaguccgcccccucccaguccgacgucgcccucauccgcuacgucaaccccgacaccggccgcacccucuucgaggccaagcuccaccgcaccggcuacaucaccgucgcccacuccggcgacuacccccucgucguccccuccaacggcuacuuccgcuucgacuccugggucaaccaguucuacucccucgcccccaugggcaccggcaacggccgccgccgcguccaguga

SEQ ID NO: 13390 - RNA, 1650 nt, Artificial Sequence
  derived and/or modified sequence opt2 from capsid_protein_VP1__Norovirus__AGI17594
augaagauggccuccaacgacgccgcccccuccaacgacggcgccgccggccucguccccgagaucaacuccgaggccauggcccucgagcccgucgccggcgccgccaucgccgccccccucaccggccagcagaacaucaucgaccccuggaucaugaacaacuucguccaggcccccggcggcgaguucaccaucuccccccgcaacggccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccaggucaccaugugcccccacgucaucgucgacguccgccagcucgagcccgucaaccuccccaugcccgacguccgcaacuccuucuuccacuacaaccagggcaccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgacaacaucgucguccagugccagaacggccgcgucacccucgacggcgagcucaugggcaccacccagcuccuccccucccagaucugcgccuuccgcggcguccucacccagcgcaccucccgcgccuccgaccaggccgacaccgccgucaccccccgcgccuucgaccaccgcuggcacauccagcucgacaaccucaacggcacccacuacgaccccuccgaggacauccccggcccccucggcauccccgacuuccgcggccgcgucuacggcgucgccucccagcgcaacuccgacggcuccacccgcgcccacgaggccaagaucgacaccaccuccucccgcuucacccccaagcucggcucccucgagaucuccaccgaguccgacgacuucgacgagaacaagcccacccgcuucacccccgucggcaucggcgucgacaacgagcgcgaguuccagcaguggucccuccccgacuacuccggccaguucacccacaacaugcaccucgcccccgccgucgcccccaacuuccccggcgagcagcuccucuucuuccgcucccaccuccccuccuccggcggcugggucgacggcacccucgacugccuccucccccaggaguggauccagcacuucuaccaggaguccgcccccucccagacccaggucgcccucguccgcuacgucaaccccgacaccggccgcguccucuucgaggccaagcuccacaaguccggcuucaugaccaucgcccgcuccggcgacucccccaucaccgucccccccaacggcuacuuccgcuucgaguccugggucaaccccuucuacacccucgcccccaugggcaccggcaacggccgccgccgcauccaguga

SEQ ID NO: 13391 - RNA, 1623 nt, Artificial Sequence
  derived and/or modified sequence opt2 from capsid_protein_VP1__Norovirus__AGK36311
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccgcgucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagauccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13392 - RNA, 1623 nt, Artificial Sequence; identical to SEQ ID NO: 13292
  derived and/or modified sequence opt2 from capsid_protein_VP1__Norovirus__AGK36314

SEQ ID NO: 13393 - RNA, 1593 nt, Artificial Sequence
  derived and/or modified sequence opt2 from capsid_protein_VP1__Norovirus__AGM33208
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcggccgccucggccuccgccgcuga

SEQ ID NO: 13394 - RNA, 1593 nt, Artificial Sequence
  derived and/or modified sequence opt2 from capsid_protein_VP1__Norovirus__AGM33214
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucaacaccacccccgacaccuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcggccgccucggccuccgccgcuga

SEQ ID NO: 13395 - RNA, 1593 nt, Artificial Sequence; identical to SEQ ID NO: 13393
  derived and/or modified sequence opt2 from capsid_protein_VP1__Norovirus__AGM33217

SEQ ID NO: 13396 - RNA, 1593 nt, Artificial Sequence
  derived and/or modified sequence opt2 from capsid_protein_VP1__Norovirus__AGM33220
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcgucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcggccgccucggccuccgccgcuga

SEQ ID NO: 13397 - RNA, 1593 nt, Artificial Sequence
  derived and/or modified sequence opt2 from capsid_protein_VP1__Norovirus__AGM33226
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaucuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcggccgccucggccuccgccgcuga

SEQ ID NO: 13398 - RNA, 1593 nt, Artificial Sequence
  derived and/or modified sequence opt2 from capsid_protein_VP1__Norovirus__AGM33229
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgucaccuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcggccgccucggccuccgccgcuga

SEQ ID NO: 13399 - RNA, 1593 nt, Artificial Sequence
  derived and/or modified sequence opt2 from capsid_protein_VP1__Norovirus__AGM33232
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucggcuccggcaacuacgucggcguccucuccuggaucuccccccccucccgccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcggccgccucggccuccgccgcuga

SEQ ID NO: 13400 - RNA, 1593 nt, Artificial Sequence; identical to SEQ ID NO: 13399
  derived and/or modified sequence opt2 from capsid_protein_VP1__Norovirus__AGM33235

SEQ ID NO: 13401 - RNA, 1593 nt, Artificial Sequence
  derived and/or modified sequence opt2 from capsid_protein_VP1__Norovirus__AGM33238
augaugauggccuccaaggacgccaccuccuccgucgacggcgccuccggcgccggccagcucguccccgaggucaacgccuccgacccccucgccauggaccccgucgccggcuccuccaccgccgucgccaccaccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucggcuccggcaacuacgucggcguccucuccuggaucuccccccccucccaccccuccggcucccaggucgaccucuggaagauccccaacuacggcuccuccaucaccgaggccacccaccucgcccccuccgucuacccccccggcuucggcgagguccucgucuucuucauguccaagaugcccggccccggcgccuacaaccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcggccgccucggccuccgccgcuga

SEQ ID NO: 13402 - RNA, 1593 nt, Artificial Sequence; identical to SEQ ID NO: 13393
  derived and/or modified sequence opt2 from capsid_protein_VP1__Norovirus__AGM33241

SEQ ID NO: 13403 - RNA, 1593 nt, Artificial Sequence; identical to SEQ ID NO: 13394
  derived and/or modified sequence opt2 from capsid_protein_VP1__Norovirus__AGM33244

SEQ ID NO: 13404 - RNA, 1626 nt, Artificial Sequence
  derived and/or modified sequence opt2 from capsid_protein_VP1__Norovirus__AGO59890
augcgcauguccgacggcgccgcccccaaggccaacggcuccgaggccuccggccaggaccucguccccgccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacaaguuccaguccggcaucggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgccgaccaggcccccuaccagggccgcgucuucgccuccgucaccgccgccgccucccucgaccucgucgacggccgcguccgcgccgucccccgcuccaucuacggcuuccaggacaccauccccgaguacaacgacggccuccucgucccccucgccccccccaucggccccuuccuccccggcgagguccuccuccgcuuccgcaccuacaugcgccagaucgacaccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacaacgagggcuacaucgcccucuccuacuccggcuccggcccccucaccuuccccaccgacggcaucuucgaggucgucuccugggucccccgccucuaccagcucgccuccgucggcucccucgccaccggccgcaugcucaagcaguga

SEQ ID NO: 13405 - RNA, 1620 nt, Artificial Sequence
  derived and/or modified sequence opt2 from capsid_protein_VP1__Norovirus__AGT17782
augaagauggccuccaacgacgccacccccuccgacggcuccuccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccucccucggccccgaccucaaccccuaccucucccaccucucccgcauguacaacggcuacgccggcuccuucgagguccaggucauccucgccggcaacgccuucaccgccggcaagaucaucuucgccgccgucccccccaacuuccgcaccgagggccucucccccucccagaucaccauguucccccacaucaucaccgacguccgccagcucgagcccguccucaucccccuccccgacauccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccgcaucggcaacucccgcgaguaccgcaugaaccucgccucccucaacuggaacaacuacgaccccaccgaggagauccccgccccccucggcacccccgacuucgccggcaagauccagggcguccucacccagaccacccgccacgacggcuccacccgcggccacaaggccaccgucuacaccggcuccgccggcuucacccccaagcucggcuccguccaguucuccaccgacaccgacaacgaccucgaggccaaccagaacacccgcuucacccccgucggcgucauccaggacggcaacgcccaccagggcgagccccagcaguggguccuccccaacuacgccggccgcgacggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 13406 - RNA, 1593 nt, Artificial Sequence; identical to SEQ ID NO: 13393
  derived and/or modified sequence opt2 from capsid_protein_VP1__Norovirus__AGT17785

SEQ ID NO: 13407 - RNA, 1623 nt, Artificial Sequence
  derived and/or modified sequence opt2 from capsid_protein_VP1__Norovirus__AGT17788
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13408 - RNA, 1593 nt, Artificial Sequence; identical to SEQ ID NO: 13393
  derived and/or modified sequence opt2 from capsid_protein_VP1__Norovirus__AGT17792

SEQ ID NO: 13409 - RNA, 1623 nt, Artificial Sequence
  derived and/or modified sequence opt2 from capsid_protein_VP1__Norovirus__AGT17795
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaucaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13410 - RNA, 1617 nt, Artificial Sequence
  derived and/or modified sequence opt2 from capsid_protein_VP1__Norovirus__AGT17798
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagguccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuucuccaccgagggccucucccccucccaggucaccauguucccccaccucaucgucgacguccgccagcucgagcccgucaugaucccccuccccgacauccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaccaccaagacccacaccuaccagaugaaccucgccgcccagaacuggaacuccuacgaccccaccgaggagacccccgccccccucggcacccccgacuucgucggcaagauccagggcguccucacccagaccaccaagggcaacggcuccacccgcgcccacaaggccaccgucuacaccggcaccgucgaguucacccccaagcucggccgcauccagcucuucaccgacaccgacaacgaccucgaggccaaccagaacaccaaguucacccccgucggcgucauccaggacggcgaccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucgucaucccccccaacggcuacuuccgcuucgacuccugggucucccccuucuacacccucgcccccaugggcaacggcaccggccgccgccgcgcccucuga

SEQ ID NO: 13411 - RNA, 1593 nt, Artificial Sequence; identical to SEQ ID NO: 13393
  derived and/or modified sequence opt2 from capsid_protein_VP1__Norovirus__AGT17803

SEQ ID NO: 13412 - RNA, 1593 nt, Artificial Sequence; identical to SEQ ID NO: 13393
  derived and/or modified sequence opt2 from capsid_protein_VP1__Norovirus__AGT17806

SEQ ID NO: 13413 - RNA, 1593 nt, Artificial Sequence; identical to SEQ ID NO: 13393
  derived and/or modified sequence opt2 from capsid_protein_VP1__Norovirus__AGT17809

SEQ ID NO: 13414 - RNA, 1623 nt, Artificial Sequence
  derived and/or modified sequence opt2 from capsid_protein_VP1__Norovirus__AGT17813
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13415 - RNA, 1623 nt, Artificial Sequence
  derived and/or modified sequence opt2 from capsid_protein_VP1__Norovirus__AGT17816
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacugguccaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacacccgcuucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13416 - RNA, 1623 nt, Artificial Sequence
  derived and/or modified sequence opt2 from capsid_protein_VP1__Norovirus__AGT17819
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcggcaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13417 - RNA, 1623 nt, Artificial Sequence
  derived and/or modified sequence opt2 from capsid_protein_VP1__Norovirus__AGT17823
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagccccuccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccaucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcacccacaacuacgccaugaaccucgccgcccagaacuggaacuccuacgaccccaccgaggagauccccgccccccucggcacccccgacuucgucggcaagauccagggcguccucacccagaccacccgcgccgacggcuccacccgcgcccacaaggccaccgucuacaccggcuccgccgaguucgcccccaagcucggccgcguccaguucgccaccgacaccgacuccgacuucgacaccaaccagaacaccaaguucacccccgucggcgucauccaggacggcaacaccgcccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucucccccuucuacacccucgcccccaugggcaacggcaccggccgccgccgcgcccucuga

SEQ ID NO: 13418 - RNA, 1593 nt, Artificial Sequence; identical to SEQ ID NO: 13393
  derived and/or modified sequence opt2 from capsid_protein_VP1__Norovirus__AGT17826

SEQ ID NO: 13419 - RNA, 1620 nt, Artificial Sequence
  derived and/or modified sequence opt2 from capsid_protein_VP1__Norovirus__AGT17830
augaagauggccuccaacgacgccacccccuccgacggcuccuccgccaaccucguccccgaggccaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccucccucggccccgaccucaaccccuaccucucccaccucucccgcauguacaacggcuacgccggcuccuucgagguccaggucauccucgccggcaacgccuucaccgccggcaagaucaucuucgccgccgucccccccaacuuccgcaccgagggccucucccccucccagaucaccauguucccccacaucaucaccgacguccgccagcucgagcccguccucaucccccuccccgacauccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccgcaucggcaacucccgcgaguaccgcaugaaccucgccucccucaacuggaacaacuacgaccccaccgaggagauccccgccccccucggcacccccgacuucgccggcaagauccagggcguccucacccagaccacccgccacgacggcuccacccgcggccacaaggccaccgucuacaccggcuccgccggcuucacccccaagcucggcuccguccaguucuccaccgacaccgacaacgaccucgaggccaaccagaacacccgcuucacccccgucggcgucauccaggacggcaacgcccaccagggcgagccccagcaguggguccuccccaacuacgccggccgcgacggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 13420 - RNA, 1623 nt, Artificial Sequence
  derived and/or modified sequence opt2 from capsid_protein_VP1__Norovirus__AGT17833
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13421 - RNA, 1593 nt, Artificial Sequence; identical to SEQ ID NO: 13393
  derived and/or modified sequence opt2 from capsid_protein_VP1__Norovirus__AGT17836

SEQ ID NO: 13422 - RNA, 1620 nt, Artificial Sequence
  derived and/or modified sequence opt2 from capsid_protein_VP1__Norovirus__AGT17842
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccggccaggucaccauguucccccacaucaucgucgacguccgccagcucgagcccguccucaucccccuccccgacguccgcaacaacuucuaccacuacaaccaguccaacgaccccaccaucaagcucgucgccaugcucuacaccccccuccgcgccaacaacgccggcgacgacgucuucaccgucuccugccgcguccucacccgccccucccccgacuucgacuucaucuuccucgucccccccaccaucgaguccaagaccaaguccuucuccguccccauccucaccaucgaggagaugaccaacucccgcuuccccaucccccucgagaagcucuucaccggccccuccuccacccucgucguccagccccagaacggccgcugcaccaccgacggcguccuccucggcaccacccagcucucccccgucaacaucugcaccuuccgcggcgacgucacccagaucaccaacacccacuccuacgagaugaaccucgccgcccagaacuggaacuccuacgaccccaccgaggagauccccgccccccucggcacccccgacuucgucggcaagauccagggcguccucacccagaccaccaaggagaacggcuccacccgcgcccacaaggccaccgucuacaccggcuccaccggcuucacccccaagcucggccgcguccaguucgucaccgacaccgaccgcgaccucgagaccaaccaggacaccaaguucacccccgucggcgucauccaggacggcgacgcccaccagaacgagccccagcaguggguccuccccuccuaccucggcaccaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccgccacgaccucgucaucccccccaacggcuacuuccgcuucgacuccugggucucccccuucuacacccucgcccccaugggcaacggcaccggccgccgccgcgcccucuga

SEQ ID NO: 13423 - RNA, 1623 nt, Artificial Sequence
  derived and/or modified sequence opt2 from capsid_protein_VP1__Norovirus__AGU68328
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcacccuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggcuacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13424 - RNA, 1620 nt, Artificial Sequence
  derived and/or modified sequence opt2 from capsid_protein_VP1__Norovirus__AGX85889
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucgccgccggcaagaucaucuucgccgccgucccccccaacuuccccaccgagggccucucccccucccaggucaccauguucccccaccucaucgucgacguccgccagcucgagcccgucaugaucccccuccccgacauccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaccaccaagacccacaccuaccagaugaaccucgccgcccagaacuggaacuccuacgaccccaccgaggagauccccgccccccucggcacccccgacuucgucggcaagauccagggcguccucacccagaccaccaagggcaacggcuccacccgcgcccacaaggccaccgucuacaccggcuccgccgaguucacccccaagcucggccgcauccagcucuucaccgacaccgacaacgaccucgaggccaaccagaacaccaaguucacccccgucggcgucauccaggacggcgacacccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucuucaucccccccaacggcuacuuccgcuucgacuccugggucucccccuucuacacccucgcccccaugggcaacggcaccggccgccgccgcgcccucuga

SEQ ID NO: 13425 - RNA, 1620 nt, Artificial Sequence
  derived and/or modified sequence opt2 from capsid_protein_VP1__Norovirus__AGX85892
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagguccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuuccccaccgagggccucucccccucccaggucaccauguucccccaccucaucgucgacguccgccagcucgagcccgucaugaucccccuccccgacauccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaccaccaagacccacaccuaccagaugaaccucgccgcccagaacuggaacuccuacgaccccaccgaggagauccccgccccccucggcacccccgacuucgucggcaagauccagggcguccucacccagaccaccaagggcaacggcuccacccgcgcccacaaggccaccgucuacaccggcggcgucgaguucacccccaagcucggccgcauccagcucuucaccgacaccgacaacgaccucgaggccaaccagaacaccaaguucacccccgucggcgucauccaggacggcgacacccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucuucaucccccccaacggcuacuuccgcuucgacuccugggucucccccuucuacacccucgcccccaugggcaacggcaccggccgccgccgcgcccucuga

SEQ ID NO: 13426 - RNA, 1620 nt, Artificial Sequence
  derived and/or modified sequence opt2 from capsid_protein_VP1__Norovirus__AGX85895
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagguccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuuccccaccgagggccucucccccucccaggucaccauguucccccaccucaucaucgacguccgccagcucgagcccgucaugaucccccuccccgacguccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaucaccaagacccacuccuaccagaugaaccucgccgcccagaacuggaacuccuacgaccccaccgaggagauccccgccccccucggcacccccgacuucgucggcaagauccagggcguccucacccagaccaccaagggcaacggcuccacccgcgcccacaaggccaccgucuacaccggcuccaccgaguucacccccaagcucggccgcauccagcucgucaccgacaccgacaacgaccucgagaccaaccagaacaccaaguucacccccgucggcgucauccaggacggcgacacccaccagaacgagccccagcaguggguccuccccuccuaccucggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucuucaucccccccaacggcuacuuccgcuucgacuccugggucucccccuucuacacccucgcccccaugggcaacggcaccggccgccgccgcgcccucuga

SEQ ID NO: 13427 - RNA, 1623 nt, Artificial Sequence
  derived and/or modified sequence opt2 from capsid_protein_VP1__Norovirus__AGX85904
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacugguccaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccauccaguucgccaccgacaccgagaacgacuucgagacccaccagaacacccgcuucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13428 - RNA, 1617 nt, Artificial Sequence
  derived and/or modified sequence opt2 from capsid_protein_VP1__Norovirus__AGX85913
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagguccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuucuccaccgagggccucucccccucccaggucaccauguucccccaccucaucgucgacguccgccagcucgagcccgucaugaucccccuccccgacauccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaccaccaagacccacaccuaccagaugaaccucgccgcccagaacuggaacuccuacgaccccaccgaggagauccccgccccccucggcacccccgacuucgucggcaagauccagggcguccucacccagaccaccaaggagaacggcuccacccgcgcccacaaggccaccgucuacaccggcaccgucgaguucacccccaagcucggccgcauccagcucuucaccgacaccgacaacgaccucgaggccaaccagaacaccaaguucacccccgucggcgucauccaggacggcgaccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucgucaucccccccaacggcuacuuccgcuucgacuccugggucucccccuucuacacccucgcccccaugggcaacggcaccggccgccgccgcgcccucuga

SEQ ID NO: 13429 - RNA, 1623 nt, Artificial Sequence
  derived and/or modified sequence opt2 from capsid_protein_VP1__Norovirus__AGX85916
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcuccuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13430 - RNA, 1617 nt, Artificial Sequence; identical to SEQ ID NO: 13428
  derived and/or modified sequence opt2 from capsid_protein_VP1__Norovirus__AGX85931

SEQ ID NO: 13431 - RNA, 1617 nt, Artificial Sequence
  derived and/or modified sequence opt2 from capsid_protein_VP1__Norovirus__AGX85934
augaagauggccuccuccgacgccaaccccuccgacggcuccaccgccaaccucguccccgaggccaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagguccucugguccgccccccucggccccgaccucaaccccuaccucucccaccucgcccgcauguacaacggcuacgccggcggcuucgagguccaggucauccucgccggcaacgccuucgccgccggcaagaucaucuucgccgccgucccccccaacuucuccaccgagggccucucccccucccaggucaccauguucccccaccucaucgucgacguccgccagcucgagcccgucaugaucccccuccccgacauccgcaacaacuucuaccacuacaaccaguccaacgaccccaccaucaagcucaucgccaugcucuacaccccccuccgcgccaacaacgucggcgacgacgucuucaccgucuccugccgcguccucacccgccccucccccgacuucgacuucaucuuccucgucccccccaccgucgaguccaagaccaaccccuucuccguccccauccucaccaucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaccaccaagacccacaccuaccagaugaaccucgccgcccagaacuggaacuccuacgaccccaccgaggagauccccgccccccucggcacccccgacuucgucggcaagauccagggcguccucacccagaccaccaagggcaacggcuccacccgcgcccacaaggccaccgucuacaccggcaccgucgaguucacccccaagcucggccgcauccagcucuucaccgacaccgacaacgaccucgaggccaaccagaacaccaaguucacccccgucggcgucauccaggacggcgaccaccagaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaccacgaccucgucaucccccccaacggcuacuuccgcuucgacuccugggucucccccuucuacacccucgcccccaugggcaacggcaccggccgccgccgcgcccucuga

SEQ ID NO: 13432 - RNA, 1644 nt, Artificial Sequence
  derived and/or modified sequence opt2 from capsid_protein_VP1__Norovirus__AHI59154
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaugguccccuccgccggcggcuacggcuccggccagaucgacugccucaugccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 13433 - RNA, 1623 nt, Artificial Sequence
  derived and/or modified sequence opt2 from capsid_protein_VP1__Norovirus__AHI59157
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13434 - RNA, 1629 nt, Artificial Sequence
  derived and/or modified sequence opt2 from capsid_protein_VP1__Norovirus__AHI59159
augaagauggccuccaacgacgccgcccccuccaccgacggcgccgccggccucguccccgaguccaacuccgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacguccccgccccccucggcguccccgacuuccagggccgcgucuucggcgucaucucccagcgcgacaagcacaacucccccggccacaacgagcccgccaaccgcggccacgacgccgucguccccaccuacaccgcccaguacacccccaagcucggccagguccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacgucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13435 - RNA, 1623 nt, Artificial Sequence
  derived and/or modified sequence opt2 from capsid_protein_VP1__Norovirus__AHK24788
augcgcauguccgacggcgccgcccccaaggccaacggcuccgaggccuccggccaggaccucguccccaccgccgucgagcaggccguccccauccagcccgucgccggcgccucccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccgccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaaggccggcgacaagcucaaggucaccaccuucgagaugauccucggccccaccaccaacgucgaccaggcccccuaccagggccgcgucuacgccucccucaccgccgccgccucccucgaccucgucgacggccgcguccgcgccgucccccgcuccaucuacggcuuccaggaccagauccccgaguacaacgacggccuccucgucccccucgccccccccgucggccccuuccuccccggcgagcuccuccuccgcuuccgcaccuacaugcgccagaucgacuccgccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaaguga

SEQ ID NO: 13436 - RNA, 1623 nt, Artificial Sequence
  derived and/or modified sequence opt2 from capsid_protein_VP1__Norovirus__AHX22018
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13437 - RNA, 1623 nt, Artificial Sequence
  derived and/or modified sequence opt2 from capsid_protein_VP1__Norovirus__AHX22021
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucaccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13438 - RNA, 1623 nt, Artificial Sequence
  derived and/or modified sequence opt2 from capsid_protein_VP1__Norovirus__AHX22025
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaccauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13439 - RNA, 1623 nt, Artificial Sequence
  derived and/or modified sequence opt2 from capsid_protein_VP1__Norovirus__AHX22028
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13440 - RNA, 1623 nt, Artificial Sequence
  derived and/or modified sequence opt2 from capsid_protein_VP1__Norovirus__AHX22032
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaccauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccagaacgagccccagcaguggguccuccccuccuacuccggccgcgacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13441 - RNA, 1623 nt, Artificial Sequence
  derived and/or modified sequence opt2 from capsid_protein_VP1__Norovirus__AHX22038
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccucaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13442 - RNA, 1623 nt, Artificial Sequence
  derived and/or modified sequence opt2 from capsid_protein_VP1__Norovirus__AHX22041
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgccaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13443 - RNA, 1623 nt, Artificial Sequence
  derived and/or modified sequence opt2 from capsid_protein_VP1__Norovirus__AHX22047
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13444 - RNA, 1623 nt, Artificial Sequence
  derived and/or modified sequence opt2 from capsid_protein_VP1__Norovirus__AHX22050
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13445 - RNA, 1623 nt, Artificial Sequence
  derived and/or modified sequence opt2 from capsid_protein_VP1__Norovirus__AHX22054
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13446 - RNA, 1647 nt, Artificial Sequence
  derived and/or modified sequence opt2 from capsid_protein_VP1__Norovirus__AIA96988
augaagauggccuccaacgacgccgcccccuccaacgacggcgccgccggccucguccccgagaucuccaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagauccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaccgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgacaacaucgucguccagugccagaacggccgcgucacccucgacggcgagcucaugggcaccacccagcuccuccccucccagaucugcgccuuccgcggcguccucacccgcuccaccucccgcgccuccgaccacgccgacaccgccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagauguccaccgaguccgacgacuucgaccagaaccagcccacccgcuucacccccgucggcaucggcgucgacaacgaggccgacuuccagcaguggacccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuacaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 13447 - RNA, 1623 nt, Artificial Sequence
  derived and/or modified sequence opt2 from capsid_protein_VP1__Norovirus__AII02569
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcucuacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13448 - RNA, 1623 nt, Artificial Sequence; identical to SEQ ID NO: 13245
  derived and/or modified sequence opt2 from capsid_protein_VP1__Norovirus__AII02572

SEQ ID NO: 13449 - RNA, 1623 nt, Artificial Sequence; identical to SEQ ID NO: 13245
  derived and/or modified sequence opt2 from capsid_protein_VP1__Norovirus__AII02575

SEQ ID NO: 13450 - RNA, 1623 nt, Artificial Sequence; identical to SEQ ID NO: 13288
  derived and/or modified sequence opt2 from capsid_protein_VP1__Norovirus__AII02578

SEQ ID NO: 13451 - RNA, 1647 nt, Artificial Sequence
  derived and/or modified sequence opt2 from capsid_protein_VP1__Norovirus__AII02581
augaagauggccuccaacgacgccgcccccuccaacgacggcgccgccggccucguccccgagaucaacuccgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccagguccuccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcaugcucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacgccaccacccgcgcccacgaggccaagaucgacaccaccuccggccgcuucacccccaagcucggcucccucgagaucuccaccgaguccggcgacuucgaccagaaccagcccacccgcuucacccccgucggcaucggcgucgaccacgaggccgacuuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcucggcuucaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 13452 - RNA, 1623 nt, Artificial Sequence
  derived and/or modified sequence opt2 from capsid_protein_VP1__Norovirus__AII02584
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13453 - RNA, 1623 nt, Artificial Sequence; identical to SEQ ID NO: 13245
  derived and/or modified sequence opt2 from capsid_protein_VP1__Norovirus__AII02590

SEQ ID NO: 13454 - RNA, 1623 nt, Artificial Sequence; identical to SEQ ID NO: 13292
  derived and/or modified sequence opt2 from capsid_protein_VP1__Norovirus__AII02593

SEQ ID NO: 13455 - RNA, 1623 nt, Artificial Sequence; identical to SEQ ID NO: 13245
  derived and/or modified sequence opt2 from capsid_protein_VP1__Norovirus__AII02596

SEQ ID NO: 13456 - RNA, 1623 nt, Artificial Sequence
  derived and/or modified sequence opt2 from capsid_protein_VP1__Norovirus__AII02599
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacaucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagcgcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13457 - RNA, 1623 nt, Artificial Sequence; identical to SEQ ID NO: 13292
  derived and/or modified sequence opt2 from capsid_protein_VP1__Norovirus__AII02602

SEQ ID NO: 13458 - RNA, 1608 nt, Artificial Sequence
  derived and/or modified sequence opt2 from capsid_protein_VP1__Norovirus__AII02605
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgaguccgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 13459 - RNA, 1647 nt, Artificial Sequence
  derived and/or modified sequence opt2 from capsid_protein_VP1__Norovirus__AII02608
augaagauggccuccaacgacgccgcccccuccaacgacggcgccgccggccucguccccgagaucaacuccgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcaugcucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacgccaccacccgcgcccacgaggccaagaucgacaccaccuccggccgcuucacccccaagcucggcucccucgagaucuccaccgaguccggcgacuucgaccagaaccagcccacccgcuucacccccgucggcaucggcgucgaccacgaggccgaccuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcucggcuucaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 13460 - RNA, 1623 nt, Artificial Sequence; identical to SEQ ID NO: 13299
  derived and/or modified sequence opt2 from capsid_protein_VP1__Norovirus__AII02614

SEQ ID NO: 13461 - RNA, 1653 nt, Artificial Sequence
  derived and/or modified sequence opt2 from capsid_protein_VP1__Norovirus__AII02623
augaagauggccuccaacgacgccacccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuucccccagcgcgcccgcaaccacccccuccacguccaggucaagaaccucgacggcacccaguacgaccccaccgacgacauccccgccguccucggcgccaucgacuucaagggcaccgucuucggcgucgccucccagcgcgacgucuccggcacccaggagcagggccacuacgccacccgcgcccacgaggcccacaucgacaccaccgaccccaaguacgcccccaagcucggcaccauccucaucaaguccgaguccaccgacuucaacaccaaccagcccauccgcuucacccccgucggcaugggcgacaacaacuggcgccagugggagcuccccgacuacuccggcucccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 13462 - RNA, 1623 nt, Artificial Sequence; identical to SEQ ID NO: 13245
  derived and/or modified sequence opt2 from capsid_protein_VP1__Norovirus__AII02626

SEQ ID NO: 13463 - RNA, 1647 nt, Artificial Sequence
  derived and/or modified sequence opt2 from capsid_protein_VP1__Norovirus__AII02629
augaagauggccuccaacgacgccgcccccuccaacgacggcgccgccggccucguccccgagaucaacuccgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcaugcucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacgccaccacccgcgcccacgaggccaagaucgacaccaccuccggccgcuucacccccaagcucggcucccucgagaucuccaccgaguccggcgacuucgaccagaaccagcccacccgcuucacccccgucggcaucggcgucgaccacgaggccgacuuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcucggcuucaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 13464 - RNA, 1623 nt, Artificial Sequence; identical to SEQ ID NO: 13295
  derived and/or modified sequence opt2 from capsid_protein_VP1__Norovirus__AII02632

SEQ ID NO: 13465 - RNA, 1623 nt, Artificial Sequence; identical to SEQ ID NO: 13245
  derived and/or modified sequence opt2 from capsid_protein_VP1__Norovirus__AII02635

SEQ ID NO: 13466 - RNA, 1608 nt, Artificial Sequence; identical to SEQ ID NO: 13458
  derived and/or modified sequence opt2 from capsid_protein_VP1__Norovirus__AII02638

SEQ ID NO: 13467 - RNA, 1623 nt, Artificial Sequence; identical to SEQ ID NO: 13245
  derived and/or modified sequence opt2 from capsid_protein_VP1__Norovirus__AII02641

SEQ ID NO: 13468 - RNA, 1647 nt, Artificial Sequence; identical to SEQ ID NO: 13463
  derived and/or modified sequence opt2 from capsid_protein_VP1__Norovirus__AII02644

SEQ ID NO: 13469 - RNA, 1623 nt, Artificial Sequence; identical to SEQ ID NO: 13280
  derived and/or modified sequence opt2 from capsid_protein_VP1__Norovirus__AII02647

SEQ ID NO: 13470 - RNA, 1623 nt, Artificial Sequence; identical to SEQ ID NO: 13292
  derived and/or modified sequence opt2 from capsid_protein_VP1__Norovirus__AII02650

SEQ ID NO: 13471 - RNA, 1623 nt, Artificial Sequence
  derived and/or modified sequence opt2 from capsid_protein_VP1__Norovirus__AII02653
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgccgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13472 - RNA, 1647 nt, Artificial Sequence; identical to SEQ ID NO: 13463
  derived and/or modified sequence opt2 from capsid_protein_VP1__Norovirus__AII02656

SEQ ID NO: 13473 - RNA, 1623 nt, Artificial Sequence; identical to SEQ ID NO: 13245
  derived and/or modified sequence opt2 from capsid_protein_VP1__Norovirus__AII02659

SEQ ID NO: 13474 - RNA, 1647 nt, Artificial Sequence; identical to SEQ ID NO: 13463
  derived and/or modified sequence opt2 from capsid_protein_VP1__Norovirus__AII02662

SEQ ID NO: 13475 - RNA, 1623 nt, Artificial Sequence; identical to SEQ ID NO: 13245
  derived and/or modified sequence opt2 from capsid_protein_VP1__Norovirus__AII02665

SEQ ID NO: 13476 - RNA, 1623 nt, Artificial Sequence; identical to SEQ ID NO: 13245
  derived and/or modified sequence opt2 from capsid_protein_VP1__Norovirus__AII02668

SEQ ID NO: 13477 - RNA, 1623 nt, Artificial Sequence; identical to SEQ ID NO: 13245
  derived and/or modified sequence opt2 from capsid_protein_VP1__Norovirus__AII02671

SEQ ID NO: 13478 - RNA, 1623 nt, Artificial Sequence
  derived and/or modified sequence opt2 from capsid_protein_VP1__Norovirus__AII02674
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13479 - RNA, 1623 nt, Artificial Sequence; identical to SEQ ID NO: 13288
  derived and/or modified sequence opt2 from capsid_protein_VP1__Norovirus__AII02677

SEQ ID NO: 13480 - RNA, 1623 nt, Artificial Sequence
  derived and/or modified sequence opt2 from capsid_protein_VP1__Norovirus__AII02680
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaucaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacauccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13481 - RNA, 1623 nt, Artificial Sequence; identical to SEQ ID NO: 13245
  derived and/or modified sequence opt2 from capsid_protein_VP1__Norovirus__AII02683

SEQ ID NO: 13482 - RNA, 1623 nt, Artificial Sequence; identical to SEQ ID NO: 13245
  derived and/or modified sequence opt2 from capsid_protein_VP1__Norovirus__AII02689

SEQ ID NO: 13483 - RNA, 1623 nt, Artificial Sequence; identical to SEQ ID NO: 13332
  derived and/or modified sequence opt2 from capsid_protein_VP1__Norovirus__AII02692

SEQ ID NO: 13484 - RNA, 1623 nt, Artificial Sequence; identical to SEQ ID NO: 13295
  derived and/or modified sequence opt2 from capsid_protein_VP1__Norovirus__AII02695

SEQ ID NO: 13485 - RNA, 1623 nt, Artificial Sequence; identical to SEQ ID NO: 13245
  derived and/or modified sequence opt2 from capsid_protein_VP1__Norovirus__AII02698

SEQ ID NO: 13486 - RNA, 1623 nt, Artificial Sequence; identical to SEQ ID NO: 13245
  derived and/or modified sequence opt2 from capsid_protein_VP1__Norovirus__AII02701

SEQ ID NO: 13487 - RNA, 1623 nt, Artificial Sequence; identical to SEQ ID NO: 13245
  derived and/or modified sequence opt2 from capsid_protein_VP1__Norovirus__AII02707

SEQ ID NO: 13488 - RNA, 1623 nt, Artificial Sequence; identical to SEQ ID NO: 13299
  derived and/or modified sequence opt2 from capsid_protein_VP1__Norovirus__AII02710

SEQ ID NO: 13489 - RNA, 1647 nt, Artificial Sequence
  derived and/or modified sequence opt2 from capsid_protein_VP1__Norovirus__AII02713
augaagauggccuccaacgacgccgcccccuccaacgacggcgccgccggccucguccccgagaucaacuccgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcaugcucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacgccaccacccgcgcccacgaggccaagaucgacaccaccuccggccgcuucacccccaagcucggcucccucgagaucuccaccgaguccggcgacuucgaccagaaccagcccaccaucuucacccccgucggcaucggcgucgaccacgaggccgacuuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcucggcuucaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 13490 - RNA, 1647 nt, Artificial Sequence; identical to SEQ ID NO: 13463
  derived and/or modified sequence opt2 from capsid_protein_VP1__Norovirus__AII02716

SEQ ID NO: 13491 - RNA, 1650 nt, Artificial Sequence
  derived and/or modified sequence opt2 from capsid_protein_VP1__Norovirus__AII02719
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucaacgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcauccucaucggccagaccucccgcucccccgacuccgacuccaccgacuccgccccccgccgccgcgaccacccccuccacaugcagcucgagaaccucgacggcacccaguacgaccccaccgacgagguccccgccgcccucggcgccgucgacuucaagggcaccaucuucggcgucgccucccagcgcgacaccuccggcacccaggucggcgccacccgcgcccacgaggucaucaucaacaccaccgacccccgcuacacccccaagcucggcuccguccucauguacuccgagucccaggacuucgagaccggccagcccauccgcuucacccccaucggcaugggcgagaacgacuggcaccagugggagcuccccaacuacuccggccgccucacccucaacaugaaccucgcccccgccgucgcccccgccuuccccggcgagcgcauccucuucuuccgcuccaucguccccuccgccggcggcuacggcuccggccagaucgacugccuccucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 13492 - RNA, 1650 nt, Artificial Sequence
  derived and/or modified sequence opt2 from capsid_protein_VP1__Norovirus__AII02722
augaagauggccuccaacgacgccgcccccuccaacgacggcgccgccaaccucguccccgaggccaacaacgaggucauggcccucgagcccgucgccggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucaacgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggccgccucaucggccagaccucccgcucccccgaccucgacuccaccgacuccgccccccgccgccgcgaccacccccuccacaugcagcucgagaaccucgacggcacccaguacgaccccaccgacgagguccccgccgcccucggcgccgucgacuucaagggcaccaucuucggcgucgccucccagcgcgacaccuccggcucccaggucggcgccacccgcgcccacgaggucaccaucaacaccaccgacccccgcuacacccccaagcucggcuccguccucauguacuccgagucccaggacuucgagaccggccagcccauccgcuucacccccaucggcaugggcgaggacgacuggcaccagugggagcuccccaacuacuccggccgccucacccucaacaugaaccucgcccccgccgucgcccccgccuuccccggcgagcgcauccucuucuuccgcuccaucguccccuccgccggcggcuacggcuccggccagaucgacugccuccucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 13493 - RNA, 1623 nt, Artificial Sequence
  derived and/or modified sequence opt2 from capsid_protein_VP1__Norovirus__AII02725
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccgucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13494 - RNA, 1623 nt, Artificial Sequence
  derived and/or modified sequence opt2 from capsid_protein_VP1__Norovirus__AII02728
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccacccgcggcgacggcuccacccgcggccacaaggccaccgucuacaccggcuccgcccccuucgcccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13495 - RNA, 1653 nt, Artificial Sequence
  derived and/or modified sequence opt2 from capsid_protein_VP1__Norovirus__AII02731
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcaaccacccccuccacguccaggucaagaaccucgacggcacccaguacgaccccaccgacgacauccccgccguccucggcgccaucgacuucaagggcaccgucuucggcgucgccucccagcgcgacgucuccggcacccaggagcagggccacuacgccacccgcgcccacgaggcccacaucgacaccaccgaccccaaguacgcccccaagcucggcaccauccucaucaaguccgaguccaccgacuucaacaccaaccagcccauccgcuucacccccgucggcaugggcgacaacaacuggcgccagugggagcuccccgacuacuccggcucccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 13496 - RNA, 1623 nt, Artificial Sequence; identical to SEQ ID NO: 13245
  derived and/or modified sequence opt2 from capsid_protein_VP1__Norovirus__AII02734

SEQ ID NO: 13497 - RNA, 1623 nt, Artificial Sequence; identical to SEQ ID NO: 13245
  derived and/or modified sequence opt2 from capsid_protein_VP1__Norovirus__AII02737

SEQ ID NO: 13498 - RNA, 1623 nt, Artificial Sequence
  derived and/or modified sequence opt2 from capsid_protein_VP1__Norovirus__AII02740
augaagauggcccccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggggcgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaacggccagcacgaccucgucaucccccccaacggcuacuuccgcuucgacuccugggucaaccaguucuacacccucgcccccaugggcaacggcaccggccgccgccgcgcccucuga

SEQ ID NO: 13499 - RNA, 1623 nt, Artificial Sequence; identical to SEQ ID NO: 13278
  derived and/or modified sequence opt2 from capsid_protein_VP1__Norovirus__AII02743

SEQ ID NO: 13500 - RNA, 1623 nt, Artificial Sequence; identical to SEQ ID NO: 13478
  derived and/or modified sequence opt2 from capsid_protein_VP1__Norovirus__AII02746

SEQ ID NO: 13501 - RNA, 1623 nt, Artificial Sequence; identical to SEQ ID NO: 13245
  derived and/or modified sequence opt2 from capsid_protein_VP1__Norovirus__AII02749

SEQ ID NO: 13502 - RNA, 1623 nt, Artificial Sequence; identical to SEQ ID NO: 13327
  derived and/or modified sequence opt2 from capsid_protein_VP1__Norovirus__AII02752

SEQ ID NO: 13503 - RNA, 1623 nt, Artificial Sequence; identical to SEQ ID NO: 13292
  derived and/or modified sequence opt2 from capsid_protein_VP1__Norovirus__AII02758

SEQ ID NO: 13504 - RNA, 1623 nt, Artificial Sequence
  derived and/or modified sequence opt2 from capsid_protein_VP1__Norovirus__AII02761
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccaccucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13505 - RNA, 1623 nt, Artificial Sequence; identical to SEQ ID NO: 13245
  derived and/or modified sequence opt2 from capsid_protein_VP1__Norovirus__AII02764

SEQ ID NO: 13506 - RNA, 1623 nt, Artificial Sequence; identical to SEQ ID NO: 13245
  derived and/or modified sequence opt2 from capsid_protein_VP1__Norovirus__AII02767

SEQ ID NO: 13507 - RNA, 1647 nt, Artificial Sequence; identical to SEQ ID NO: 13463
  derived and/or modified sequence opt2 from capsid_protein_VP1__Norovirus__AII02770

SEQ ID NO: 13508 - RNA, 1623 nt, Artificial Sequence; identical to SEQ ID NO: 13245
  derived and/or modified sequence opt2 from capsid_protein_VP1__Norovirus__AII02773

SEQ ID NO: 13509 - RNA, 1650 nt, Artificial Sequence
  derived and/or modified sequence opt2 from capsid_protein_VP1__Norovirus__AII02776
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucaacgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcauccucaucggccagaccucccgcucccccgacuccgacuccaccgacuccgccccccgccgccgcgaccacccccuccacaugcagcucgagaaccucgacggcacccaguacgaccccaccgacgagguccccgccgcccucggcgccgucgacuucaagggcaccaucuucggcgucgccucccagcgcgacaccuccggcucccaggucggcgccacccgcgcccacgaggucaucaucaacaccaccgacccccgcuacacccccaagcucggcuccguccucauguacuccgagucccaggacuucgagaccggccagcccauccgcuucacccccaucggcaugggcgagaacgacuggcaccagugggagcuccccaacuacuccggccgccucacccucaacaugaaccucgcccccgccgucgcccccgccuuccccggcgagcgcauccucuucuuccgcuccaucguccccuccgccggcggcuacggcuccggccagauggacugccuccucccccaggaguggauccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 13510 - RNA, 1623 nt, Artificial Sequence; identical to SEQ ID NO: 13245
  derived and/or modified sequence opt2 from capsid_protein_VP1__Norovirus__AII02779

SEQ ID NO: 13511 - RNA, 1623 nt, Artificial Sequence; identical to SEQ ID NO: 13245
  derived and/or modified sequence opt2 from capsid_protein_VP1__Norovirus__AII02782

SEQ ID NO: 13512 - RNA, 1623 nt, Artificial Sequence
  derived and/or modified sequence opt2 from capsid_protein_VP1__Norovirus__AII02785
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccuccaucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgccgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13513 - RNA, 1647 nt, Artificial Sequence; identical to SEQ ID NO: 13463
  derived and/or modified sequence opt2 from capsid_protein_VP1__Norovirus__AII02788

SEQ ID NO: 13514 - RNA, 1647 nt, Artificial Sequence; identical to SEQ ID NO: 13463
  derived and/or modified sequence opt2 from capsid_protein_VP1__Norovirus__AII02791

SEQ ID NO: 13515 - RNA, 1623 nt, Artificial Sequence
  derived and/or modified sequence opt2 from capsid_protein_VP1__Norovirus__AII02794
augaagauggccuccuccgacgccaaccccuccgacggcuccaccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccaguccuggaacuccuacgaccccaccgaggagauccccgccccccucggcucccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13516 - RNA, 1623 nt, Artificial Sequence; identical to SEQ ID NO: 13245
  derived and/or modified sequence opt2 from capsid_protein_VP1__Norovirus__AII02797

SEQ ID NO: 13517 - RNA, 1623 nt, Artificial Sequence; identical to SEQ ID NO: 13245
  derived and/or modified sequence opt2 from capsid_protein_VP1__Norovirus__AII02800

SEQ ID NO: 13518 - RNA, 1623 nt, Artificial Sequence; identical to SEQ ID NO: 13494
  derived and/or modified sequence opt2 from capsid_protein_VP1__Norovirus__AII02803

SEQ ID NO: 13519 - RNA, 1623 nt, Artificial Sequence; identical to SEQ ID NO: 13245
  derived and/or modified sequence opt2 from capsid_protein_VP1__Norovirus__AII02806

SEQ ID NO: 13520 - RNA, 1623 nt, Artificial Sequence; identical to SEQ ID NO: 13478
  derived and/or modified sequence opt2 from capsid_protein_VP1__Norovirus__AII02809

SEQ ID NO: 13521 - RNA, 1647 nt, Artificial Sequence; identical to SEQ ID NO: 13463
  derived and/or modified sequence opt2 from capsid_protein_VP1__Norovirus__AII02812

SEQ ID NO: 13522 - RNA, 1623 nt, Artificial Sequence
  derived and/or modified sequence opt2 from capsid_protein_VP1__Norovirus__AII02815
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13523 - RNA, 1647 nt, Artificial Sequence
  derived and/or modified sequence opt2 from capsid_protein_VP1__Norovirus__AII02818
augaagauggccuccaacgacgccgcccccuccaacgacggcgccgccggccucguccccgagaucaacuccgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcaugcucacccgcuccaccucccgcgccuccgaccaggccgacaccgucaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacgccaccacccgcgcccacgaggccaagaucgacaccaccuccggccgcuucacccccaagcucggcucccucgagaucuccaccgaguccgacgacuucuaccagaaccagcccacccgcuucacccccgucggcaucggcgucgaccacgaggccgacuuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 13524 - RNA, 1623 nt, Artificial Sequence
  derived and/or modified sequence opt2 from capsid_protein_VP1__Norovirus__AII02821
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13525 - RNA, 1623 nt, Artificial Sequence; identical to SEQ ID NO: 13245
  derived and/or modified sequence opt2 from capsid_protein_VP1__Norovirus__AII02824

SEQ ID NO: 13526 - RNA, 1623 nt, Artificial Sequence; identical to SEQ ID NO: 13245
  derived and/or modified sequence opt2 from capsid_protein_VP1__Norovirus__AII02827

SEQ ID NO: 13527 - RNA, 1623 nt, Artificial Sequence; identical to SEQ ID NO: 13245
  derived and/or modified sequence opt2 from capsid_protein_VP1__Norovirus__AII02830

SEQ ID NO: 13528 - RNA, 1623 nt, Artificial Sequence
  derived and/or modified sequence opt2 from capsid_protein_VP1__Norovirus__AII02833
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcggcgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13529 - RNA, 1623 nt, Artificial Sequence
  derived and/or modified sequence opt2 from capsid_protein_VP1__Norovirus__AII02836
augaagauggccuccaacgacgccaaccccuccgacggcuccgccgccaaccucguccccgaggucuccaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13530 - RNA, 1623 nt, Artificial Sequence; identical to SEQ ID NO: 13319
  derived and/or modified sequence opt2 from capsid_protein_VP1__Norovirus__AII02839

SEQ ID NO: 13531 - RNA, 1623 nt, Artificial Sequence; identical to SEQ ID NO: 13327
  derived and/or modified sequence opt2 from capsid_protein_VP1__Norovirus__AII02842

SEQ ID NO: 13532 - RNA, 1647 nt, Artificial Sequence; identical to SEQ ID NO: 13463
  derived and/or modified sequence opt2 from capsid_protein_VP1__Norovirus__AII02845

SEQ ID NO: 13533 - RNA, 1647 nt, Artificial Sequence; identical to SEQ ID NO: 13463
  derived and/or modified sequence opt2 from capsid_protein_VP1__Norovirus__AII02848

SEQ ID NO: 13534 - RNA, 1623 nt, Artificial Sequence; identical to SEQ ID NO: 13278
  derived and/or modified sequence opt2 from capsid_protein_VP1__Norovirus__AII02851

SEQ ID NO: 13535 - RNA, 1623 nt, Artificial Sequence; identical to SEQ ID NO: 13245
  derived and/or modified sequence opt2 from capsid_protein_VP1__Norovirus__AII02854

SEQ ID NO: 13536 - RNA, 1623 nt, Artificial Sequence
  derived and/or modified sequence opt2 from capsid_protein_VP1__Norovirus__AII02857
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13537 - RNA, 1623 nt, Artificial Sequence; identical to SEQ ID NO: 13245
  derived and/or modified sequence opt2 from capsid_protein_VP1__Norovirus__AII02860

SEQ ID NO: 13538 - RNA, 1623 nt, Artificial Sequence; identical to SEQ ID NO: 13245
  derived and/or modified sequence opt2 from capsid_protein_VP1__Norovirus__AII02866

SEQ ID NO: 13539 - RNA, 1623 nt, Artificial Sequence
  derived and/or modified sequence opt2 from capsid_protein_VP1__Norovirus__AII02869
augaagauggccuccaacgacgccaaccccaccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13540 - RNA, 1623 nt, Artificial Sequence; identical to SEQ ID NO: 13245
  derived and/or modified sequence opt2 from capsid_protein_VP1__Norovirus__AII02872

SEQ ID NO: 13541 - RNA, 1623 nt, Artificial Sequence; identical to SEQ ID NO: 13245
  derived and/or modified sequence opt2 from capsid_protein_VP1__Norovirus__AII02875

SEQ ID NO: 13542 - RNA, 1647 nt, Artificial Sequence; identical to SEQ ID NO: 13463
  derived and/or modified sequence opt2 from capsid_protein_VP1__Norovirus__AII02878

SEQ ID NO: 13543 - RNA, 1623 nt, Artificial Sequence; identical to SEQ ID NO: 13245
  derived and/or modified sequence opt2 from capsid_protein_VP1__Norovirus__AII02881

SEQ ID NO: 13544 - RNA, 1623 nt, Artificial Sequence; identical to SEQ ID NO: 13245
  derived and/or modified sequence opt2 from capsid_protein_VP1__Norovirus__AII02884

SEQ ID NO: 13545 - RNA, 1647 nt, Artificial Sequence; identical to SEQ ID NO: 13463
  derived and/or modified sequence opt2 from capsid_protein_VP1__Norovirus__AII02887

SEQ ID NO: 13546 - RNA, 1623 nt, Artificial Sequence; identical to SEQ ID NO: 13327
  derived and/or modified sequence opt2 from capsid_protein_VP1__Norovirus__AII02890

SEQ ID NO: 13547 - RNA, 1623 nt, Artificial Sequence; identical to SEQ ID NO: 13280
  derived and/or modified sequence opt2 from capsid_protein_VP1__Norovirus__AII02893

SEQ ID NO: 13548 - RNA, 1623 nt, Artificial Sequence
  derived and/or modified sequence opt2 from capsid_protein_VP1__Norovirus__AII02896
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccgcgucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagauccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccaccgcuccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13549 - RNA, 1647 nt, Artificial Sequence
  derived and/or modified sequence opt2 from capsid_protein_VP1__Norovirus__AII02899
augaagauggccuccaacgacgccgcccccuccaacgacggcgccgccggccucguccccgagaucaacuccgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcaugcucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacgccaccacccgcgcccacgaggccaagaucgacaccaccuccggccgcuucacccccaagcucggcucccucgagaucuccaccgaguccggcgacuucgaccagucccagcccacccgcuucacccccgucggcaucggcgucgaccacgaggccgacuuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcucggcuucaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 13550 - RNA, 1623 nt, Artificial Sequence; identical to SEQ ID NO: 13245
  derived and/or modified sequence opt2 from capsid_protein_VP1__Norovirus__AII02902

SEQ ID NO: 13551 - RNA, 1647 nt, Artificial Sequence
  derived and/or modified sequence opt2 from capsid_protein_VP1__Norovirus__AIS24557
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaccgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgacaacaucgucguccagugccagaacggccgcgucacccucgacggcgagcucaugggcaccacccagcuccuccccucccagaucugcgccuuccgcggcguccucacccgcuccaccucccgcgccuccgaccaggccgacgccgccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccggcgacuucgaccagaaccagcccacccgcuucacccccgucggcaucggcgucgacaacgaggccgacuuccagcaguggacccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuacaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 13552 - RNA, 1620 nt, Artificial Sequence
  derived and/or modified sequence opt2 from capsid_protein_VP1__Norovirus__AIY30135
augcgcauguccgacggcgccgcccccaaggccgacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggccaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggcaaggucuucgccuccaucaccgccgccgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucaucuccugguucgccuccaacgucuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucuga

SEQ ID NO: 13553 - RNA, 1623 nt, Artificial Sequence
  derived and/or modified sequence opt2 from capsid_protein_VP1__Norovirus__AKE07100
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccauccccguccucaccaucgaggagaugaccaacucccgcuuccccaucccccucgagaagcucuucaccggccccuccuccgccuucgucguccagccccagaacggccgcugcuccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccguccucaccggcuccgccaacuucacccccaagcucggccgcauccaguucgccaccgacaccgacaacgacuucgagaccaaccagaacaccaaguucacccccgucggcgucauccaggacggcgacaccgcccaccgcaacgagccccagcaguggguccuccccuccuacuccggccgcaacacccacaacguccaccucgcccccgccgucgcccccaccuuccccggcgagcagcuccucuucuuccgcuccaccauccccggcugcuccggcuaccccaacauggaccucgacugccuccucccccaggaguggguccaguucuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13554 - RNA, 1623 nt, Artificial Sequence
  derived and/or modified sequence opt2 from capsid_protein_VP1__Norovirus__AKE07103
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagucccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaucgacggcguccuccucggcaccacccagcucucccccgucaacaucugcaccuuccgcggcgacgucacccacaucgccggcacccacaacuacaccaugaaccucgccacccagaacuggaacuccuacgaccccaccgaggagauccccgccccccucggcacccccgacuucgucggcaagauccagggcguccucacccagaccaccaagaccgacggcuccacccgcggccacaaggccaccgucugcaucggcuccgccgacuucgcccccaagcucggccgcguccaguucgagaccgacaccaacaacgaccucgagaccaaccagaacaccaaguucacccccgucggcgucauccagaacggcgagaccgcccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggcucccacgaccucgucaucccccccaacggcuacuuccgcuucgacuccugggucaaccaguucuacacccucgcccccaugggcaacggcaccggccgccgccgcgccaccuga

SEQ ID NO: 13555 - RNA, 1623 nt, Artificial Sequence
  derived and/or modified sequence opt2 from capsid_protein_VP1__Norovirus__AKE07106
augaagauggccuccuccgacgccaaccccuccgacggcuccaccgccaaccucguccccgaggucaacgacgaggucauggcccucgagcccgucgucggcgccgcccucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacgcccgcaacaacuucuaccacuacaaccaguccaacgaguccaccaucaagcucaucgccaugcucuacaccccccuccgcgccaacaacgccggcgacgacgucuucaccgucuccugccgcguccucacccgccccucccucgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgccguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaaccgcuccaacuacgaccccaccgaggagauccccgccccccucggcacccccgacuucgucggcaagauccagggcgcccucacccagaccacccgcgccgacggcuccacccgcggccacaaggccaccgucuacaccggcuccgccgacuucacccccaagcucggccgcguccaguucgccaccgacaccgaccacgacuucgacaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggagugggucgcccacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13556 - RNA, 1719 nt, Artificial Sequence
  derived and/or modified sequence opt2 from capsid_protein_VP1__Norovirus__ALQ12260
augaagauggccuccaacggcgccgccgcccccucccaggacggcgccgccaaccucguccccgagucccagcaggagguccucgcccucgagcccgucgccggcgccgcccucgccgcccccgucgccggccaguucaacgccaucgaccccuggaucaagcagaacuucguccaggcccccgccggcgaguucaccgucuccccccgcaacgcccccggcgagguccucauggaccucgagcucggccccgagaugaaccccuuccucgcccaccucgcccagauguacaacgccuacgccggcggcauggagguccagaucauccucgccggcaacgccuucaccgccggcaagaucaucgucugcgccgucccccccaacuucccccccgaccgccucuccgccucccaggccaccaacuucccccacgucaucauggacguccgcacccucgagcccgucguccucccccuccccgacguccgcgccggcuucuuccacuacaaccagcuccgcgagccccgcaugcgccucaugacccuccucuacaccccccuccgcgccaacggcaccggcgacgacgccuucaccgucuccugccgcguccucacccgccccaugcucgacuucgaguucauguuccucgucccccccaccgucgagucccgcgucacccccuucuccguccccaccuaccccgucgucgagaugaccaacucccgcuggcccgcccgcaucuccggcaugcacgucaacgccaaccagacccucgccguccaguuccagaacggccgcugcacccucgacggccagcucaugggcaccacccagcucugcgccgccgacgucugccgcaugcgcggccgcuacaccuccacccgcgccgaccccgccggccucggcugggaccucgacgccaccacccucgucgacggccccgaggcccgcguccaggcccgcaucuccgucuccgcccaccuccagcucgaggagcucuccggccagcccuacgaggucuacggcgagcagcccgccccccucggcacccccgacuuccagugccgccucaugggcgagcucguccgccuccccuccgccaaccccgucgcccagucccgcuuccgcgacgccuucuucgacaccuacggcgcccucuucgcccccgccgucggcuccgucaccgucaccgucaacaacuccuccuccuccgacuucgccaacgaccagcccuucgaguuccuccccaucggcgucgagaucggcaacuccgcccgcuacgacgaguucgcccuccccuccuacaacggcgccaucggcgagaaccgccaccucgcccccaucgccgcccccggcuuccccggcgagaaccucaucuucuucuccuccaaccuccccgucugggacuccaccuccgcccaguccaaccgccgcaucuccugccuccuccccaacgaguucauccagcacuucuacgaccuccaggcccccucccaguccgacgucgcccuccuccgcuacguccaccccgagaccgaccgcuuccucuucgagugcaagcucuaccgcgacgccuuccucaccgucaacggcgccuccuacgccgaguuccccgucaacggcuacucccgcuucgacuccugggucaagcaguucuucacccucucccccgucggcaccggcuccggccgccgcggccgcucccgcaaggcccaguga

SEQ ID NO: 13557 - RNA, 1620 nt, Artificial Sequence
  derived and/or modified sequence opt2 from capsid_protein_VP1__Norovirus__BAI49904
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaagucccgcuuccccaucccccucgagaagcucuacaccggccccuccuccgccuucgucguccagccccagaacggccgcugcaccaccgacggcguccuccucggcaccacccagcucuccgucgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcuuccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcguccucuga

SEQ ID NO: 13558 - RNA, 1623 nt, Artificial Sequence
  derived and/or modified sequence opt2 from capsid_protein_VP1__Norovirus__BAI49905
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccuccacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13559 - RNA, 1623 nt, Artificial Sequence
  derived and/or modified sequence opt2 from capsid_protein_VP1__Norovirus__BAI49906
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccacggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13560 - RNA, 1623 nt, Artificial Sequence
  derived and/or modified sequence opt2 from capsid_protein_VP1__Norovirus__BAI49907
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuucaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13561 - RNA, 1623 nt, Artificial Sequence
  derived and/or modified sequence opt2 from capsid_protein_VP1__Norovirus__BAI49909
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcaccuacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13562 - RNA, 1623 nt, Artificial Sequence
  derived and/or modified sequence opt2 from capsid_protein_VP1__Norovirus__BAI49910
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcgagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13563 - RNA, 1623 nt, Artificial Sequence
  derived and/or modified sequence opt2 from capsid_protein_VP1__Norovirus__BAI49911
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccacccgcggcgacggccucacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucgaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13564 - RNA, 1623 nt, Artificial Sequence
  derived and/or modified sequence opt2 from capsid_protein_VP1__Norovirus__BAI49912
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggccgcauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccuccgcaacgagccccagcaguggguccuccccgacuacuccggccgcaccguccacaacguccaccucgcccccgccgucgcccucaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccaccgcgccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13565 - RNA, 1623 nt, Artificial Sequence
  derived and/or modified sequence opt2 from capsid_protein_VP1__Norovirus__BAI49914
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13566 - RNA, 1623 nt, Artificial Sequence
  derived and/or modified sequence opt2 from capsid_protein_VP1__Norovirus__BAI49916
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcggcguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13567 - RNA, 1623 nt, Artificial Sequence
  derived and/or modified sequence opt2 from capsid_protein_VP1__Norovirus__BAI49917
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggaggucaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13568 - RNA, 1623 nt, Artificial Sequence
  derived and/or modified sequence opt2 from capsid_protein_VP1__Norovirus__BAI49918
augaagauggccuccaacgacgccaaccccuccgacggcuccgccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13569 - RNA, 1623 nt, Artificial Sequence
  derived and/or modified sequence opt2 from capsid_protein_VP1__Norovirus__BAI49919
augaagauggccuccaacgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13570 - RNA, 1623 nt, Artificial Sequence
  derived and/or modified sequence opt2 from capsid_protein_VP1__Norovirus__BAI49920
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccggcuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13571 - RNA, 1623 nt, Artificial Sequence
  derived and/or modified sequence opt2 from capsid_protein_VP1__Norovirus__BAI49921
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucaucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccucgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcacccuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13572 - RNA, 1623 nt, Artificial Sequence
  derived and/or modified sequence opt2 from capsid_protein_VP1__Norovirus__BAI49923
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13573 - RNA, 1623 nt, Artificial Sequence
  derived and/or modified sequence opt2 from capsid_protein_VP1__Norovirus__BAI49924
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaucaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacacccgcuucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcguccucuga

SEQ ID NO: 13574 - RNA, 1623 nt, Artificial Sequence
  derived and/or modified sequence opt2 from capsid_protein_VP1__Norovirus__BAI49925
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcuccgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacacccgcuucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcguccucuga

SEQ ID NO: 13575 - RNA, 1623 nt, Artificial Sequence
  derived and/or modified sequence opt2 from capsid_protein_VP1__Norovirus__BAI49926
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucaccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcaucaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13576 - RNA, 1623 nt, Artificial Sequence
  derived and/or modified sequence opt2 from capsid_protein_VP1__Norovirus__BAI49927
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13577 - RNA, 1623 nt, Artificial Sequence
  derived and/or modified sequence opt2 from capsid_protein_VP1__Norovirus__BAI49928
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccucaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13578 - RNA, 1620 nt, Artificial Sequence
  derived and/or modified sequence opt2 from capsid_protein_VP1__Norovirus__BAJ25070
augaagauggccuccuccgacgccgcccccuccaacgacggcgccaccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuacaacaaccagcccgccccccgcaugcgccucgucgccaugcucuacaccccccuccgcuccaacggcuccggcgaggacgucuucaccgucuccugccgcguccucacccgccccacccccgacuucgaguucaccuaccucgucccccccuccgucgaguccaagaccaagcccuucucccuccccauccucaccaucggcgagcucaccaacucccgcuuccccgcccccaucgaccagcucuucaccuccaccaacaacgacgucgucguccagccccagaacggccgcugcacccucgacggcgagcuccagggcaccacccagcuccucuccaccgccaucugcuccuaccgcggcaccaccuccaaccccaucgacgacugggacgaccaccuccuccaccucacccaccccaacggcgccaccuacgaccccaccgaggacguccccgcccccuucggcacccaggacuuccagggcauccucuacggcaugcucacccagaacccccagaccggcggcggcgaggccgccaacucccgcggcgucuacaucuccuccaccuccgacaaguucacccccaagcucggcaccaucggccuccaccacguccagggcggcgacgucgccaacaaccagaaguccaaguucacccccaucggcaucgccgagaacggcaacacccccuuccgccaguggguccuccccaacuacuccggccgccucacccucaacaccaaccucgcccccgccgucggccccaacuuccccggcgagcagauccucuucuuccgcuccaacguccccuccguccagggcggccacuccaucgagaucgacugccucaucccccaggaguggaucucccacuucuaccaggaguccgcccccucccaguccgacgucgcccucauccgcuacgucaaccccgacaccggccgcacccucuucgaggccaagcuccaccgccagggcuucaucaccaucgccaccaccggcaacaaccccgucgucgucccccccaacggcuacuuccgcuucgacuccugggucaaccaguucuacgcccucgcccccaugggcaccggcaacggccgccgccgcguccaguga

SEQ ID NO: 13579 - RNA, 1620 nt, Artificial Sequence
  derived and/or modified sequence opt2 from capsid_protein_VP1__Norovirus__BAJ25072
augaagauggccuccaacgacgccgcccccuccaacgacggcgccaccggccucguccccgagaucaacaccgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccucaugaaccucgagcucggccccgaccucaaccccuaccucgcccaccucgcccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuacaacaaccagcccgccccccgcaugcgccucgucgccaugcucuacaccccccuccgcuccaacggcuccggcgaggacgucuucaccgucuccugccgcguccucacccgccccacccccgacuucgaguucaccuaccucgucccccccuccgucgaguccaagaccaagcccuucucccuccccauccucaccaucggcgagcucaccaacucccgcuuccccgcccccaucgaccagcucuucaccuccaccaacaacgacgucgucguccagccccagaacggccgcugcacccucgacggcgagcuccagggcaccacccagcuccucuccaccgccgucugcuccuaccgcggcaccaccuccaaccccaucgacgacugggacgaccaccuccuccaccucacccaccccaacggcgccaccuacgaccccaccgaggacguccccgcccccuucggcacccaggacuuccagggcauccucuacggcaugcucacccagaacccccaggccggcggcggcgaggccgccuccucccgcggcgucuacaucuccuccaccuccgacaaguucacccccaagcucggcaccaucggccuccaccgcguccagggcggcgccgucgccgacaaccagaaguccaaguucacccccaucggcaucgccgagaacgacaacacccccuuccgccaguggguccuccccaacuacuccggccgccucacccucaacaccaaccucgcccccgccgucggccccaacuuccccggcgagcagauccucuucuuccgcuccaacguccccuccguccagggcggccacuccaucgagaucgacugccucaucccccaggagugggucucccacuucuaccaggaguccgcccccucccaguccgacgucgcccucauccgcuacgucaaccccgacaccggccgcacccucuucgaggccaagcuccaccgccagggcuucaucaccaucgccaccaccggcaacaaccccgucgucgucccccccaacggcuacuuccgcuucgacuccugggucaaccaguucuacgcccucgcccccaugggcaccggcaacggccgccgccgcguccaguga

SEQ ID NO: 13580 - RNA, 1608 nt, Artificial Sequence
  derived and/or modified sequence opt2 from capsid_protein_VP1__Norovirus__BAJ25076
augaagauggccuccaacgacgccaaccccuccuccgacggcuccgccaaccucguccccgagaucuccaacgaggucauggcccucgagcccgucgccggcgccgccaucgccgcccccgucgccggccagcagaacaucaucgaccccuggauccgcaacaacuucguccaggcccccggcggcgaguucaccgucuccccccgcaacgcccccggcgagguccuccucaaccucccccucucccccgacaucaaccccuaccucgcccaccucucccgcauguacaacggcuacgccggcggcgucgaggucgaggucguccucgccggcaacgccuucaccgccggcaagaucaucuucgccgccgucccccccaacuucccccccgagaaccucucccccucccagaucaccaugcucccccacaucaucgucgacguccgccagcucgagcccguccgcaucccccuccccgacguccgcaacaacuucuaccacuacucccgcgagaacgacuccacccuccgccucaucgccaugcucuacaccccccuccgcgccaacaacgccggcgacgacgucuucaccgucuccugccgcguccucacccgccccucccccgacuucgacuucaucuuccucgucccccccaccgucgaguccaaguccaagcccuucaccauccccaugcucaccaucgaggagaugaccaacucccgcuuccccgccccccucgagcucaugaccaccggccccucccacgacaucgucguccagccccagaacggccgcugcaccaucgacggcguccuccucggcaccacccagcucucccccgucaacaucugcucccuccgcggcguccccaccaagcgcaccaacggcaacgacaacugcuucguccagcucgagaaccccaacggcuccgccuacgaccccaccgaggacauccccgccguccucggcucccccgacuucgucggcgagcucuacggcaccaucacccagcgcuccuccgacaacuccacccgcgcccaccccuucacccucaacaccggcuccccccgcuacacccccaagaucggcuccgucgacauccgcgucaccgacgucuccgaccuccaggaccacgaccccgucaagcucacccccgucggccucuccggcgaccgcggcuccauccaccaguggcagcuccccaacuacuccggcgucgccacccacaacaugcaccucgcccccuccgucgccccccucuuccccggcgagcagauccucuucuuccgcuccaccguccccggcugcggcggcuaccccaacuccaacaucgacugccucaucccccaggaguggguccagcacuucuaccaggagggcgcccccgcccgcaccgacgucgcccuccuccgcuucaucaaccccgacaccggccgcguccucuucgagugcaagcuccacaagcacggcuucaucaccgucgccuacuccggcaaccacgaccucgucaugccccccaacggcuacuuccgcuucgaguccugggucaaccaguuccacacccucgcccccaugggcaccggcuccggccgccgccgcauccaguga

SEQ ID NO: 13581 - RNA, 1644 nt, Artificial Sequence
  derived and/or modified sequence opt2 from capsid_protein_VP1__Norovirus__BAN16283
augaagauggccuccuccgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggcgaccaggucggcgccacccgcgcccacgagguccacaucaacaccaccgacccccgcuacacccccaagcucggcuccauccucaugcacuccgaguccggcgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaucguccccuccgccggcggcuacggcaccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 13582 - RNA, 1644 nt, Artificial Sequence
  derived and/or modified sequence opt2 from capsid_protein_VP1__Norovirus__BAN16285
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaugguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 13583 - RNA, 1644 nt, Artificial Sequence
  derived and/or modified sequence opt2 from capsid_protein_VP1__Norovirus__BAN16287
augaagauggccuccaacgacgccgcccccuccaacgacggcgccgccaaccucguccccgaggccaacaacgaggucauggcccucgagcccgucgccggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucaagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucauccacuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaugguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccacaacggcuacuuccgcuucgaggccugggucaaccaguucuacacccucacccccaugggcaccggccagggccgccgccgcaaccaguga

SEQ ID NO: 13584 - RNA, 1644 nt, Artificial Sequence
  derived and/or modified sequence opt2 from capsid_protein_VP1__Norovirus__BAN16289
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccguccucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 13585 - RNA, 1644 nt, Artificial Sequence
  derived and/or modified sequence opt2 from capsid_protein_VP1__Norovirus__BAN16291
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagaugaagaaccucgacggcacccccuacgaccccaccgacgagguccccgccguccucggcgccaucgacuucaagggcaccgucuucggcgucgccucccagcgcaacaccaccggcaacuccgucggcgccacccgcgcccacgagguccacaucgacaccaccaacccccgcuacacccccaagcucggcuccguccucaugaacuccgaguccuccgacuucgacgacggccagcccauccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 13586 - RNA, 1644 nt, Artificial Sequence
  derived and/or modified sequence opt2 from capsid_protein_VP1__Norovirus__BAN16293
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcaacuccgucggcgccacccgcgcccacgagguccacaucgacaccaccaacccccgcuacacccccaagcucggcuccguccucaugaacuccgaguccuccgacuucgacgacggccagcccauccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 13587 - RNA, 1644 nt, Artificial Sequence
  derived and/or modified sequence opt2 from capsid_protein_VP1__Norovirus__BAN16295
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggagguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaggacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcuccuccgucggcgccacccgcgcccacgagguccacaucgacaccaccaacccccgcuacacccccaagcucggcuccguccucaugcacuccgaguccuccgacuucgacgacggccagcccacccgcuucacccccaucggcaugggcgccgacgacuggcgccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 13588 - RNA, 1653 nt, Artificial Sequence
  derived and/or modified sequence opt2 from capsid_protein_VP1__Norovirus__BAN16297
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccguccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccgucgacuccccccagcgcgcccgcgaccacccccuccacguccaggucaagaaccucgacggcacccaguacgaccccaccgacgacauccccgccguccucggcgccaucgacuucaagggcaccgucuucggcgucgccucccagcgcgacgucuccggcacccaggagcagggccacuacgccacccgcgcccacgaggcccacaucgacaccaccgaccccaaguacgcccccaagcucggcaccauccucaucaaguccgacuccaacgacuucaacaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 13589 - RNA, 1623 nt, Artificial Sequence
  derived and/or modified sequence opt2 from capsid_protein_VP1__Norovirus__BAR42289
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 13590 - RNA, 1617 nt, Artificial Sequence
  derived and/or modified sequence opt2 from capsid_protein_VP1__Norovirus__BAR47616
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgccgagaccgaccaccgcgacaaguggcacaugcagcuccagaaccucaacggcaccaccuacgaccccaccgacgacguccccgccccccucggcacccccgacuucaagggcgucgucuucggcgucgccucccagcgcaacgucggcaacgacgcccccggcuccacccgcgcccacgaggccgucaucuccaccuacuccccccaguucguccccaagcucggcuccgucaacuuccgcuccaacgacaacgacuuccagcuccagcccaccaaguucacccccgucggcaucaacgacgacggcgaccaccccuuccgccagugggagcuccccgacuacuccggccuccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 13591 - RNA, 1617 nt, Artificial Sequence; identical to SEQ ID NO: 13590
  derived and/or modified sequence opt2 from capsid_protein_VP1__Norovirus__BAR63715

SEQ ID NO: 13592 - RNA, 1617 nt, Artificial Sequence; identical to SEQ ID NO: 13590
  derived and/or modified sequence opt2 from capsid_protein_VP1__Norovirus__BAR63718

SEQ ID NO: 13593 - RNA, 1617 nt, Artificial Sequence; identical to SEQ ID NO: 13590
  derived and/or modified sequence opt2 from capsid_protein_VP1__Norovirus__BAR63721

SEQ ID NO: 13594 - RNA, 1623 nt, Artificial Sequence
  derived and/or modified sequence opt2 from capsid_protein_VP1__Norovirus__BAS02083
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13595 - RNA, 1635 nt, Artificial Sequence
  derived and/or modified sequence opt2 from capsid_protein_VP1__Norovirus__CRL46952
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagcgcguccucaaccucaccgagcucgacggcucccccuucauggccuucgccgcccccgcccccgccggcuuccccgaccucggcuccugcgacuggcacaucgagauguccaagauccccaacuccuccacccagaacaaccccaucgucgucaacuccgucaagcccaacucccagcaguucgucccccaccucuccuccaucacccucgacgacaucgucuccuccggcggcgacuacaucggcaccauccaguggaccuccccccccuccgacuccggcggcgccaacaccaacuucuggaagauccccgacuacggcuccucccucuccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucggcguccgccgcuga

SEQ ID NO: 13596 - RNA, 1623 nt, Artificial Sequence
  derived and/or modified sequence opt2 from capsid_protein_VP1__Norovirus__CRL46955
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccgacaacucccagcucaacgucuggaccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 13597 - RNA, 1623 nt, Artificial Sequence
  derived and/or modified sequence opt2 from capsid_protein_VP1__Norovirus__CRL46958
augaagauggccuccaacgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccauccccauccucaccgucgaggagaugaccaacucccgcuuccccaucccccucgagaagcucuacaccggccccuccuccgccuucgucguccagccccagaacggccgcugcaccaccgacggcguccuccucggcaccacccagcucucccccgucaacaucugcaccuuccgcggcgacgucaccaacauccagggcucccacaccuacaccaugaaccucgccucccucaacuggaacaacuacgaccccaccgaggagacccccgccccccucggcacccccgacuucgucggcaagauccagggcguccucacccagaccaccaagggccagggcuccacccgcggccacaaggccaccgucuacaccggcuccgccuccuucacccccaagcucggcuccguccaguuccgcaccgacacccagaacgacuucgucacccaccagaacaccaaguucacccccgucggcgucauccaggacggcgacaccacccaccgcaacgagccccagcaguggguccuccccaacuacuccggcgucaacacccacaacguccaccucgcccccgccgucgcccccaccauccccggcgagcagcuccucuucuuccgcuccuccaugcccggcugcuccggcuaccccaacauggaccucgacugccucgucccccaggaguggguccagcacuucuaccaggaggccgcccccgcccucuccgacgucgcccuccuccgcuucgucaaccccgacaccggccgcguccucuucgagugcaagcuccacaaguccggcuacgucaccgucgcccacaccggccaccacgaccucgucaucccccccaacggcuacuuccgcuucgacuccugggucaaccaguucuacacccucgcccccaugggcaacggcaccggccgccgccgcguccucuga

SEQ ID NO: 13598 - RNA, 1623 nt, Artificial Sequence
  derived and/or modified sequence opt2 from capsid_protein_VP1__Norovirus__CRL46961
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucucccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13599 - RNA, 1623 nt, Artificial Sequence
  derived and/or modified sequence opt2 from capsid_protein_VP1__Norovirus__CRL46964
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgacuucgucguccagccccagaacggccgcugcaccaccgacggcguccuccucggcaccacccagcucucccccgucaacaucugcaccuuccgcggcgacgucacccacaccaccggcucccgcaacuacaccaugaaccucgccucccagaacuggaacaacuacgaccccaccgaggagacccccgccccccucggcacccccgacuucgucggcaagauccgcggcaugcucacccagaccacccgcgccgacggcuccacccgcggccacaaggccaccgucuacaccggcuccgccgacuucgcccccaagcucggccgcguccaguucgagaccgacaccgacaacgacuucgacgccaaccagaacaccaaguucacccccgucggcgucauccaggacggcaccaccacccaccgcaacgagccccgccaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguucuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgccgucuga

SEQ ID NO: 13600 - RNA, 1644 nt, Artificial Sequence
  derived and/or modified sequence opt2 from capsid_protein_VP1__Norovirus__CRL46967
augaagauggccuccaacgacgccgcccccuccaacgacggcgccgccaaccucguccccgaggccaccuccgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgaggccaucgucguccagccccagaacggccgcugcacccucgacggcacccuccagggcaccacccagcucguccccacccagaucugcuccuuccgcggcacccucaucucccagaccucccgcuccgccgacuccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcuccuccaucggcgccacccgcgcccacgagguccacaucgacaccaccaacccccgcuacgcccccaagcucggcuccguccucauguacuccgaguccaccgacuucgacgacggccagcccacccgcuucacccccaucggcaugggcgccgacgacuggcaccagugggagcuccccgaguacuccggccaccucacccucaacaugaaccucgcccccgccgucgcccccgccuuccccggcgagcgcauccucuucuuccgcuccgucguccccuccgccggcggcuacggcuccggccacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 13601 - RNA, 1647 nt, Artificial Sequence
  derived and/or modified sequence opt2 from capsid_protein_VP1__Norovirus__CRL46970
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccucgacaccaccacccgcgcccacgaggccaagaucgacaccaccuccggccgcuucacccccaagcucggcucccucgagaucuccaccgaguccuccgacuucgaccagucccagcccacccgcuucacccccgucggcaucggcgucgaccacgaggccgacuuccagcaguggacccuccccgacuacgccggccaguucacccacaacaugaaccucgcccccgccgucgcccccaacuuccccggcgagcagcuccucuucuuccgcucccaccuccccuccuccggcggccgcuccaacggcauccucgacugccucgucccccaggaguggguccagcacuucuaccaggaguccgcccccucccagucccaggucgcccucguccgcuacgucaaccccgacaccggccgcguccucuucgaggccaagcuccacaagcucggcuucaugaccaucgccaagaacggcgacucccccaucaucgucccccccaacggcuacuuccgcuucgaguccugggucaaccccuucuacacccucgcccccaugggcaccggcaacggccgccgccgcauccaguga

SEQ ID NO: 13602 - RNA, 1608 nt, Artificial Sequence
  derived and/or modified sequence opt2 from capsid_protein_VP1__Norovirus__CRL46973
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagguccuccucgagcucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuucccccucgagaaccucucccccggccagaucaccauguucccccacgucaucaucgacguccgcacccucgagcccguccuccucccccuccccgacguccgcaacaacuucuuccacuacaaccagcagcccgaggcccgcaugaagcucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccguccccaucgacauccucuacaccucccccaacgagggcgucgucguccagccccagaacggccgcuccacccucgacggcgagcuccucggcaccacccagaucguccccuccaacaucugcgcccuccgcggccgcaucaacgcccacguccccaacgagcccaaccaguggaaccuccaggucaccaacgccaacggcacccccuucgaccccaccgaggacguccccgccccccucggcacccccgacuuccaggccaacaucuacggcgucaccggccagcgcaacuccgacuccuccugccgcgcccacgacggcguccucgccaccuggucccccaaguucacccccaagcucggcuccgucguccucggcaccugggagaaggaggacuucaacaucaaccagcccacccgcuucacccccaucggccuccacaacaccgagcacuucaagcaguggguccuccccaacuacuccggcaugcucacccucaacaugaaccucgcccccuccgucgccccccucuuccccggcgagcagauccucuucuuccgcuccuucaucccccucaacggcggcaaguccgacggcgccaucgacugccuccucccccaggaguggauccagcacuucuaccaggaguccgcccccucccccaccgacgucgcccucauccgcuacaccaaccccgacaccggccgcguccucuucgaggccaagcuccaccgccagggcuucaucaccgucgccuccuccggcuccaagcccaucgucgucccccccaacggcuacuuccgcuucgacuccugggucaaccaguucuacucccucgcccccaugggcaccggcaacggccgccgccgcguccaguga

SEQ ID NO: 13603 - RNA, 1623 nt, Artificial Sequence
  derived and/or modified sequence opt2 from capsid_protein_VP1__Norovirus__CRL46976
augaagauggccuccaacgacgccgcccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13604 - RNA, 1623 nt, Artificial Sequence
  derived and/or modified sequence opt2 from capsid_protein_VP1__Norovirus__CRL46979
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13605 - RNA, 1623 nt, Artificial Sequence
  derived and/or modified sequence opt2 from capsid_VP1__Norovirus__ABC96332
augaagauggcccccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucuccaucugcaccuuccgcggcgacgucacccacauccccggcacccgcaucuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13606 - RNA, 1623 nt, Artificial Sequence
  derived and/or modified sequence opt2 from major_capsid_protein_VP1__Norovirus__ADB27027
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcauccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13607 - RNA, 1626 nt, Artificial Sequence
  derived and/or modified sequence opt2 from major_capsid_protein_VP1__Norovirus__AEE10003
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccgcgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugguccucggccccgagaccaacgucgaccaggcccccuaccagggccgcgucuacgccuccgucaacgccgccgccucccucgaccucgucgacggccgcguccgcgccgucccccgcuccgucuacuccuuccaggacgucauccccgaguacaacgacggccuccucgucccccucgccccccccaucggccccuuccuccccggcgagguccuccuccgcuuccgcaccuacaugcgccagaucgacaccaccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcgcccucaccuuccccaccgacggcuucuucgaggucgucuccugggucccccgccucuaccagcucgccuccgucggcucccucgccaccggccgcacccucaagcaguga

SEQ ID NO: 13608 - RNA, 1626 nt, Artificial Sequence; identical to SEQ ID NO: 13607
  derived and/or modified sequence opt2 from major_capsid_protein_VP1__Norovirus__AEE10006

SEQ ID NO: 13609 - RNA, 1626 nt, Artificial Sequence; identical to SEQ ID NO: 13607
  derived and/or modified sequence opt2 from major_capsid_protein_VP1__Norovirus__AEE10009

SEQ ID NO: 13610 - RNA, 1626 nt, Artificial Sequence
  derived and/or modified sequence opt2 from major_capsid_protein_VP1__Norovirus__AEE10015
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccgcgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugguccucggccccgagaccaacgucgaccaggcccccuaccagggccgcgucuacgccuccgucaacgccgccgccucccucgaccucgucgacggccgcguccgcgccgucccccgcuccgucuacuccuuccaggacgucauccccgaguacaacgacggccuccucgucccccucgccccccccaucggccccuuccuccccggcgagguccuccuccgcuuccgcaccuacaugcgccagaucgacaccaccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcgcccucaccuuccccaccgacggcuucuucgaggucgucuccugggucccccgccucuaccagcucgccuccgucggcucccucgccaccggccgcacccucaagcaguga

SEQ ID NO: 13611 - RNA, 1626 nt, Artificial Sequence; identical to SEQ ID NO: 13607
  derived and/or modified sequence opt2 from major_capsid_protein_VP1__Norovirus__AEE10018

SEQ ID NO: 13612 - RNA, 1626 nt, Artificial Sequence; identical to SEQ ID NO: 13610
  derived and/or modified sequence opt2 from major_capsid_protein_VP1__Norovirus__AEE10021

SEQ ID NO: 13613 - RNA, 1626 nt, Artificial Sequence
  derived and/or modified sequence opt2 from major_capsid_protein_VP1__Norovirus__AEE10024
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccaguccggcaucggcgaggucgccaccuucaaccucaucgagcaggacggcuccgccuacacccccggcgaccgcgccgccccccucggcuaccccgacuucuccggccagcucgagaucgagguccagaccgagaccaccaagaccggcgacaagcucaaggucaccaccuucgagauggcccucggccccaagaccaacgucgaccagacccccuaccagggccgcgucuucgccuccaucaccgucgccgccucccucgaccucgucgacggccgcguccgcgccgucccccgcuccgucuacggcuuccaggacaccauccccgaguacaacgacggccuccucgucccccucgccccccccaucggccccuuccuccccggcgagguccuccuccgcuuccgcaccuacaugcgccagcucgacgccaccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 13614 - RNA, 1626 nt, Artificial Sequence
  derived and/or modified sequence opt2 from major_capsid_protein_VP1__Norovirus__AEE10027
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucaccaugaucgagcaggacggcuccgccuacguccccggcgaccgcgccgccccccucggcuaccccgacuacuccggccagcucgagaucgagguccagaccgagaccaccaagaccggcgacaagcuccgcgucaccaccuucgagaugauccucggccccaccaccaacgucgaccaggcccccuaccagggcaaggucuacgccucccucuccaccuccgccucccucaaccucgucgacggccgcguccgcgccgucccccgcuccgucuacuccuuccaggacguccuccccgaguacaacgacggccuccucgucccccucgcccccccccucggccccuuccuccccggcgagguccuccuccgcuuccgcaccuacaugcgccagcucgacaccgccgacgccaccgcccagcccaucgacugcgcccucccccaggaguucaucuccugguucgccuccaacaacuucaccguccaguccgacgcccuccucauccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 13615 - RNA, 1608 nt, Artificial Sequence
  derived and/or modified sequence opt2 from major_capsid_protein_VP1__Norovirus__AGI96385
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagguccuccucaaccucgagcucggccccgagcucaaccccuuccucgcccaccucucccgcauguacaacggcuacgccggcggcgccgagguccagguccuccucgccggcaacgccuucaccgccggcaagcucgucuucgccgccauccccccccacuucccccucgagaaccucucccccggccagaucaccauguucccccacgucaucaucgacguccgcacccucgagcccguccuccucccccuccccgacguccgcaacaacuucuuccacuacaaccagcagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccguccccaucgacgagcucuacaccucccccaacgagggcgucaucguccagccccagaacggccgcuccacccucgacggcgagcuccucggcaccacccagcucguccccuccaacaucugcgcccuccgcggccgcaucaacgcccagguccccgacgaccaccaccaguggaaccuccaggucaccaacgccaacggcaccuccuucgaccccaccgaggacguccccaccccccucggcacccccgacuuccucgccaacaucuacggcgucaccucccagcgcaaccccgacaacaccugccgcgcccacgacggcguccucgccaccuggucccccaaguucacccccaagcucggcuccgucguccucggcaccugggaggaguccgaccucgaccucaaccagcccacccgcuucacccccgucggccucuacgacaccaaccacuucgaccaguggauccuccccaacuacuccggccgccucacccucaacaugaaccucgcccccuccgucgccccccucuuccccggcgagcagauccucuucuuccgcucccacaucccccucaagggcggcaccuccaacggcgccaucgacugccuccucccccaggaguggauccagcacuucuaccaggaguccgcccccucccccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 13616 - RNA, 1644 nt, Artificial Sequence
  derived and/or modified sequence opt2 from major_capsid_protein_VP1__Norovirus__AGI96397
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucaacgccgcccagaucaccaugugcccccacgucaucgucgacguccgccagcucgagcccguccuccucccccuccccgacauccgcaaccgcuucuuccacuacaaccaggagaacaccucccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucucccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcucccccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucauguacuccgaguccgacgacuucgucaccggccagcccguccgcuucacccccaucggcaugggcgacaacgacuggcaccagugggagcuccccgacuaccccggccaccucacccucaacaugaaccucgcccccgccgucgcccccgccuuccccggcgagcgcauccucuucuuccgcuccaucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcgaccaguga

SEQ ID NO: 13617 - RNA, 1608 nt, Artificial Sequence
  derived and/or modified sequence opt2 from major_capsid_protein_VP1__Norovirus__AGI96398
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagguccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuucccccucgagaaccucucccccggccagaucaccauguucccccacgucaucaucgacguccgcacccucgagcccguccuccucccccuccccgacguccgcaacaacuucuuccacuacaaccagcagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccguccccaucgacgagcucuacaccucccccaacgagggcgucaucguccagccccagaacggccgcuccacccucgacggcgagcuccucggcaccacccagcucguccccuccaacaucugcgcccuccgcggccgcaucaacgcccagguccccgacgaccaccaccaguggaaccuccaggucaccaacgccaacggcaccuccuucgaccccaccgaggacguccccgccccccucggcacccccgacuuccucgccaacaucuacggcgucaccucccagcgcaaccccgacaacaccugccgcgcccacgacggcguccucgccaccuggucccccaaguucacccccaagcucggcuccgucguccucggcaccugggaggaguccgaccucgaccucaaccagcccacccgcuucacccccgucggccucuacgacaccaaccacuucgaccaguggauccuccccaacuacuccggccgccucacccucaacaugaaccucgcccccuccgucgccccccucuuccccggcgagcagauccucuucuuccgcucccacaucccccucaagggcggcaccuccaacggcgccaucgacugccuccucccccaggaguggauccagcacuucuaccaggaguccgcccccucccccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 13618 - RNA, 1608 nt, Artificial Sequence
  derived and/or modified sequence opt2 from major_capsid_protein_VP1__Norovirus__AGI96399
augaagauggccuccaacgacgccgcccccuccaacgacgacgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagguccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuucccccucgagaaccucucccccggccagaucaccauguucccccacgucaucaucgacguccgcacccucgagcccguccuccucccccuccccgacguccgcaacaacuucuuccacuacaaccagcagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucgcccuccccauccucaccaucggcgagcucuccaacucccgcuuccccguccccaucgacgagcucuacaccucccccaacgagggcgucaucguccagccccagaacggccgcuccacccucgacggcgagcuccucggcaccacccagcucguccccuccaacaucugcgcccuccgcggccgcaucaacgcccagguccccgacgaccaccaccaguggaaccuccaggucaccaacgccaacggcaccuccuucgaccccaccgaggacguccccgccccccucggcacccccgacuuccucgccaacaucuacggcgucaccucccagcgcaaccccgacaacaccugccgcgcccacgacggcguccucgccaccuggucccccaaguucacccccaagcucggcuccgucguccucggcaccugggaggaguccgaccucgaccucaaccagcccacccgcuucacccccgucggccucuacgacaccaaccacuucgaccaguggauccuccccaacuacuccggccgccucacccucaacaugaaccucgcccccuccgucgccccccucuuccccggcgagcagauccucuucuuccgcucccacaucccccucaagggcggcaccuccaacggcgccaucgacugccuccucccccaggaguggauccagcacuucuaccaggaguccgcccccucccucaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 13619 - RNA, 1617 nt, Artificial Sequence
  derived and/or modified sequence opt2 from major_capsid_protein_VP1__Norovirus__AGJ52175
augauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucuccuuccagacccaggaccgcgaccccucccaguccgucaccuucgccaccaacgacgccuccuucguccccuaccucggcuccgucuccccccacaacggcgagggcuuccaggccggcgacaucaucggcucccucggcuggaucuccgcccccuccgacaacucccaguucaacgucugggccauccccaaguacggcuccucccuccagaugucccccauccuccuccuccucugcuccccccgccucugggaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 13620 - RNA, 1641 nt, Artificial Sequence
  derived and/or modified sequence opt2 from major_capsid_protein_VP1__Norovirus__AGX01092
augaugauggccuccaaggacgccccccaguccgccgacggcgccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcuucgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcuccuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccuccuccggcgaccccaugcgcuccgucuccguccagaccaacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacaucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcggccgccucggcguccgccgcaucuga

SEQ ID NO: 13621 - RNA, 1647 nt, Artificial Sequence
  derived and/or modified sequence opt2 from major_capsid_protein_VP1__Norovirus__AGX01095
augaagauggccuccaacgacgccgcccccuccaacgacggcgccgccggccucguccccgagaucuccuccgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacaccgccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacgccaccacccgcgcccacgaggccaagaucgacaccaccuccggccgcuucacccccaagcucggcucccucgagaucuccaccgaguccggcgacuucgaccagaaccagcccacccgcuucacccccgucggcaucggcgucgaccacgagcccgacuuccagcagugggcccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcuccgcuucaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 13622 - RNA, 1623 nt, Artificial Sequence
  derived and/or modified sequence opt2 from major_capsid_protein_VP1__Norovirus__AGX01098
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggucaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaacggccagcacgaccucgucaucccccccaacggcuacuuccgcuucgacuccugggucaaccaguucuacacccucgcccccaugggcaacggcaccggccgccgccgcgcccucuga

SEQ ID NO: 13623 - RNA, 1623 nt, Artificial Sequence
  derived and/or modified sequence opt2 from major_capsid_protein_VP1__Norovirus__AKI30060
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccaucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 13624 - RNA, 1626 nt, Artificial Sequence
  derived and/or modified sequence opt2 from major_capsid_protein_VP1__Norovirus__BAQ94514
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucucccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucuucuaccucgucccccccuccgucgaguccaagaccaaguccuucacccuccccauccucaccaucuccgagaugaccaacucccgcuuccccauccccaucgagcagcucuacaccgcccccaacgagaccaacgucguccagugccagaacggccgcugcacccucgacggcgagcuccagggcaccacccagcuccucuccuccgccaucugcuccuaccgcggccgcacccucgccaacaacgacuccugggaccagaaccuccuccagcucuccuaccccaacggcgccuccuacgaccccaccgacgagguccccgccccccucggcacccaggacuucuccggcauccucuacggcguccucacccaggacaacgucaccgagggcaccggcgaggccaagaacgccaagggcaucuacaucuccaccaccuccggcaaguucacccccaagaucggcuccaucggccuccacuccaucaccggcgacguccaccacaaccagcagucccgcuucacccccgucggcaucgccgucaacgagaacacccccuucaagcaguggguccucccccacuacuccggcucccucgcccucaacaccaaccucgcccccgccgucgcccccaccuuccccggcgagcagcuccucuucuuccgcucccgcguccccugcguccagggccuccacggccaggacgccuucaucgacugccuccucccccaggagugggucaaccacuucuaccaggaggccgcccccucccagaccgacgucgcccucauccgcuucgucaaccccgacaccggccgcacccucuucgaggccaagcuccaccgcuccggcuucaucaccgucucccacaccggcaacuacccccucgucaucccccccaacggccacuuccgcuucgacuccugggucaaccaguucuacucccucgcccccaugggcaccggcaacggccgccgccgcauccaguga

SEQ ID NO: 13625 - RNA, 1626 nt, Artificial Sequence
  derived and/or modified sequence opt2 from major_capsid_protein_VP1__Norovirus__BAQ94516
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucucccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucuucuaccucgucccccccuccgucgaguccaagaccaagcccuucacccuccccauccucaccaucuccgagaugaccaacucccgcuuccccauccccaucgagcagcucuacaccgcccccaacgagaccaacgucguccagugccagaacggccgcugcacccucgacggcgagcuccagggcaccacccagcuccucuccuccgccaucugcuccuaccgcggccgcacccucgccaacaacgacuccugggaccagaaccuccuccagcucuccuaccccaacggcgccuccuacgaccccaccgacgagguccccgccccccucggcacccaggacuucuccggcauccucuacggcguccucacccaggacaacgucaccgagggcaccggcgaggccaagaacgccaagggcaucuacaucuccaccaccuccggcaaguucacccccaagaucggcuccaucggccuccacuccaucaccggcgacguccaccacaaccagcagucccgcuucacccccgucggcaucgccgucaacgagaacacccccuucaagcaguggguccucccccacuacuccggcucccucgcccucaacaccaaccucgcccccgccgucgcccccaccuuccccggcgagcagcuccucuucuuccgcucccgcguccccugcguccagggccuccacggccaggacgccuucaucgacugccuccucccccaggagugggucaaccacuucuaccaggaggccgcccccucccagaccgacgucgcccucauccgcuucgucaaccccgacaccggccgcacccucuucgaggccaagcuccaccgcuccggcuucaucaccgucucccacaccggcaacuacccccucgucaucccccccaacggccacuuccgcuucgacuccugggucaaccaguucuacucccucgcccccaugggcaccggcaacggccgccgccgcauccaguga

SEQ ID NO: 13626 - RNA, 1629 nt, Artificial Sequence
  derived and/or modified sequence opt2 from major_capsid_protein_VP1__Norovirus__BAQ94520
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagcgcaccggcgaggccaagaacgccaagggcaucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcguccaguga

SEQ ID NO: 13627 - RNA, 1629 nt, Artificial Sequence
  derived and/or modified sequence opt2 from major_capsid_protein_VP1__Norovirus__BAQ94524
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagcaccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagcgcaccggcgaggccaagaacgccaagggcaucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcguccaguga

SEQ ID NO: 13628 - RNA, 1629 nt, Artificial Sequence
  derived and/or modified sequence opt2 from major_capsid_protein_VP1__Norovirus__BAQ94526
augaagauggccuccaacgacgccgcccccuccaacgacggcgccgccucccucguccccgaggccaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaccuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccuccggcgccuccuacgaccccaccgacgagguccccgccccccucggcacccaggacuucuccggcauccucuacggcguccucacccaggacaacgucuccgagcgcaccggcgaggccaagaacgccaagggcaucuacaucuccaccaccuccggcaaguucacccccaagaucggcuccaucggccuccacuccaucaccgagaacguccaccccaaccagcagucccgcuucacccccgucggcgucgcccagaacgagaacacccccuuccagcaguggguccucccccacuacgccggcgcccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggcuacuuccgcuucgacuccugggucaaccaguucuacucccucgcccccaugggcaccggcaacggccgccgccgcguccaguga

SEQ ID NO: 13629 - RNA, 1587 nt, Artificial Sequence
  derived and/or modified sequence opt2 from VP1_capsid_protein__Norovirus__ACV89840
augaugauggccuccuccgacgccaccccccccuccgagggcgccaccaaccucguccccgaggucaacacccaggucgucccccucgagcccgucgccggcgccgccgccgccgcccccuucaccggccagaacaacgucaucgaccccuggaucuuccagaacuucguccaggccccccagggcgaguucaccgucuccccccgcaacacccccggcgagauccuccuccgcaucccccucggccccaaccucaaccccuuccucgcccaccucucccgcauguacaacgccugggucggcggcauggaggccgagaugauccucgccggcaacgccuucaccgccggcaagcuccucaucgucgcccucccccccggcuucgaggccacccagcucacccccgcccaggccaccgccuucccccacgucaucgccgacguccgcacccucgagcccauccccaucccccuccccgacauccgcaacguccucuuccacuacaacggcgaccccacccccaccauccagaucgucgucaugcucuacaccccccuccgcaccaacggcaacggcgacgacgucuucaccgucuccggccgccuccucacccgccccgcccccgacuucuccuucuccuuccucgucccccccaccgucgagcagaagacccgcuccuucacccuccccaaccucgccgucuccgaccucuccaacucccgcuuccccgcccccgucaacauccuccgcgccgaccccaacaccacccucgcccucgacuaccagaacggccgcugcacccucgacggcgcccuccagggcaccacccccaccaacuccuccuuccucggcuaccuccgcggcaccgucgaccgcgucaacuccgaccagguccacguccaccuccgcgagcccaacggcgaccccuuccagcucggccuccccggcccccagggcguccccgacuaccgcgccacccucgacaucuacgucgacugggagaacaagaaccacggcaaccccugcgagggcacccucaacaccggcucccagaccgaguacacccccggccucggcacccucaccuucaacaagaccuccggcgacacccccgagcagggcgaccccgucaucaugcgccucgucgccuuccgcuccaaccucaccgaccagcuccccgccuacaacggcgccuucggccagggcgagaaccucgccccccccgucuccccccccguccccggcgaggucuuccuccaguucggcucccgcuacacccgccucggcgagcgcgagcucgccguccagugccuccuccccuccgaguggaucacccacuucuacuccgaggccgcccccauccagggcgaggccaugcuccuccgcuacguccagcccgaccucggccgcauccucuucgaggccaagcucuacaaggagggcuucgucaccgucgccggcggcaccaaccccgucaccuuccccaucgacggcaccuucgucgccgucuccugggucucccgcaacuucguccucucccccaugggcuccggccagggccgccgccgcgccgcccucgccgaguga

SEQ ID NO: 13630 - RNA, 1587 nt, Artificial Sequence
  derived and/or modified sequence opt2 from VP1_capsid_protein__Norovirus__ACV89843
augaugauggccuccuccgacgccaccccccccuccgagggcgccaccaaccucguccccgaggucaacacccaggucgucccccucgagcccgucgccggcgccgccgccgccgcccccuucaccggccagaacaacgucaucgaccccuggaucuuccagaacuucguccaggccccccagggcgaguucaccgucuccccccgcaacacccccggcgagauccuccuccgcaucccccucggccccaaccucaaccccuuccucgcccaccucucccgcauguacaacgccugggucggcggcauggaggccgagaugauccucgccggcaacgccuucaccgccggcaagcuccucaucgucgcccucccccccggcuucgaggccacccagcucacccccgcccaggccaccgccuucccccacgucaucgccgacguccgcacccucgagcccauccccaucccccuccccgacauccgcaacguccucuuccacuacaacggcgaccccacccccaccauccagaucgucgucaugcucuacaccccccuccgcaccaacggcaacggcgacgacgucuucaccgucuccggccgccuccucacccgccccgcccccgacuucuccuucuccuuccucgucccccccaccgucgagcagaagacccgccccuucacccuccccaaccucgccgucuccgaccucuccaacucccgcuuccccgcccccgucaacauccuccgcgccgaccccaacaccacccucgcccucgacuaccagaacggccgcugcacccucgacggcgcccuccagggcaccacccccaccaacuccuccuuccucggcuaccuccgcggcaccgucgaccgcgucaacuccgaccagguccacguccaccuccgcgagcccaacggcgaccccuuccagcucggccuccccggcccccagggcguccccgacuaccgcgccacccucgacaucuacgucgacugggagaacaagaaccacggcaaccccugcgagggcacccucaacaccggcucccagaccgaguacacccccggccucggcacccucaccuucaacaagaccuccggcgacacccccgagcagggcgaccccgucaucaugcgccucgucgccuuccgcuccaaccucaccgaccagcuccccgccuacaacggcgccuucggccagggcgagaaccucgccccccccgucuccccccccguccccggcgaggucuuccuccaguucggcucccgcuacacccgccucggcgagcgcgagcucgccguccagugccuccuccccuccgaguggaucacccacuucuacuccgaggccgcccccauccagggcgaggccaugcuccuccgcuacguccagcccgaccucggccgcauccucuucgaggccaagcucuacaaggagggcuucgucaccgucgccggcggcaccaaccccgucaccuuccccaucgacggcaccuucgucgccgucuccugggucucccgcaacuucguccucucccccaugggcuccggccagggccgccgccgcgccgcccucgccgaguga

SEQ ID NO: 13631 - RNA, 1767 nt, Artificial Sequence
  derived and/or modified sequence opt2 from VP1_capsid_protein__Norovirus__AFV48046
augcgccuccagugggaggccuggcgcuccaccuuccccggcaugcagccccccugcgucggcugcggccucggccccucccuccuccgcccccgccgcaucguccagcccuaccuccucaugcgcauguccgacgccguccaccgcggcaacgccgccgacacccagggcgccuccgccggcgagggcuccaaccucguccccuccaccgucgaccaggccauccccauccagcccgucgccggcgccgccaucgccgcccccaccgccggccaggucaaccagaucgaccccuggauccgcgagaacuucguccagugcccccucggcgaguucaccgucuccccccgcaacacccccggcgagguccucuucaaccucgcccucggccccggccucaaccccuaccucucccaccucgccgccauguacaccggcugggucggcaacauggagguccagcucguccucgccggcaacgccuucaccgccggcaaggucgucgucgcccucaucccccccuacuucaacaugcagacccucaccaccucccagaucaccugcuucccccacaucaugugcgacguccgcacccucgagcccauccuccucccccuccucgacguccgccgcacccucuggcaccccaccaacuccgaggacgacaccaugcgccucgucugcaugcucuacaccccccuccgcaccaacucccccggcgacgaguccuucgucgucuccggccgccuccucucccgccccucccucgacuucaacuuccucuaccucaccccccccaucgcccagacccccuacgagcuccccaccgucccccgcaugguccccuccgagaugacccacucccgcuggcccgcccccaucuaccaggucgucgccgaccccucccucgucgccaacccccaguggcagaacggccgcgucaccaucgacggccagcuccucggcaccacccccaucuccuccaccugggucugcuccaucgccggcaccgccgacuaccgcuacaucgccggcaccgacuccuucgaggagugcaagcucgcccucucccagcccaacggcucccccuucgucgucggcgacgcccccgcccccuacggcuaccccgacuucaacgccaccaucuccuucuccuuccaggucgagacccgccagaacuccgccuacuccguccgcgaguucucccucaccaccuccucccagaccaucaaccagucccccuacaccggcaccgucuacauggaccgcuccgagacccaggacuaccaguaccaggacgaccgcauccgcggcgucccccacuccguccaguccuucaaggaccagcuccccgacuacgucgaguccggccagccccccaaccucgccccccccaucggccccuucaugcccggcgagguccucguccgcuuccgcaccuacguccgccaggaggccaccgccgcccucuaccaggaccagcccaucgacugcgcccucccccaggaguucgucacccaccucgccacccacggcuacacccucggcuccgacgcccuccuccuccgcuaccgcaaccuccgcaccggccagcucaucugcgaggccaagcucuacgccgagggcuuccucgccaucuccuacuccggcaccggcccccuccagcuccccaccgacggcgucuucgaggucgucuccuggguccagcgccucuaccagcucgcccccgucggcaccuccaccgccggccgcucccucggcuccuga

SEQ ID NO: 13632 - RNA, 1767 nt, Artificial Sequence
  derived and/or modified sequence opt2 from VP1_capsid_protein__Norovirus__AFV48048
augcgccuccagugggaggccuggcgcuccaccuuccccggcaugcagccccccugcgucggcugcggccucggccccucccuccuccgcccccgccgcaucguccagcccuaccuccucaugcgcauguccgacgccguccaccgcggcaacgccgccgacacccagggcgccuccgccggcgagggcuccaaccucguccccuccaccgucgaccaggccauccccauccagcccgucgccggcgccgccaucgccgcccccaccgccggccaggucaaccagaucgaccccuggauccgcgagaacuucguccagugcccccucggcgaguucaccgucuccccccgcaacacccccggcgagguccucuucaaccucgcccucggccccggccucaaccccuaccucucccaccucgccgccauguacaccggcugggucggcaacauggagguccagcucauccucgccggcaacgccuucaccgccggcaaggucgucgucgcccucaucccccccuacuucaacaugcagacccucaccaccucccagaucaccugcuucccccacaucaugugcgacguccgcacccucgagcccauccuccucccccuccucgacguccgccgcacccucuggcaccccaccaacuccgaggacgacaccaugcgccucgucugcaugcucuacaccccccuccgcaccaacucccccggcgacgaguccuucgucgucuccggccgccuccucucccgccccucccucgacuucaacuuccucuaccucaccccccccaucgcccagacccccuacgagcuccccaccgucccccgcaugauccccuccgagaugacccacucccgcuggcccgcccccaucuaccaggucgucgccgaccccucccuccucgccaacccccaguggcagaacggccgcgucaccaucgacggccagcuccucggcaccacccccaucuccuccaccugggucugcuccaucgccggcaccgccgacuaccgcuacaucuccggcuccgacuccuucgaggagugcaagcucgcccucucccagcccaacggcucccccuucgucgucggcgacgcccccgcccccuacggcuaccccgacuucuccgccaccaucuccuucuccuuccaggucgagacccgccagaacuccgccuacuccguccgcgaguucucccucaccaccuccucccagaccaucaaccagucccccuacaccggcaccgucuacauggaccgcuccgagacccucgacuaccaguaccaggacgaccgcauccgcggcgucccccacuccguccacgccuuccgcgaccagcuccccgacuacgucgaguccggccagccccccaaccucgccccccccaucggccccuucaugcccggcgagguccuccuccgcuuccgcaccuacguccgccaggaggccaccgccgcccucuaccaggaccagcccaucgacugcgcccucccccaggaguucgucacccaccucgccacccacggcuacacccucggcuccgacgcccuccuccuccgcuaccgcaaccuccgcaccggccagcucaucugcgaggccaagcucuacgccgagggcuuccucgccaucuccuacuccggcaccggcccccuccagcuccccaucgacggcgucuucgaggucgucuccuggguccagcgccucuaccagcucgcccccgucggcaccuccaccgccggccgcucccucgccuccuga

SEQ ID NO: 13633 - RNA, 1623 nt, Artificial Sequence
  derived and/or modified sequence opt2 from VP1_capsid_protein__Norovirus__AGH06682
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuuccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccguccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccgacaacucccagcucaacgucuggaccauccccaaguacggcuccucccuccccgacgucacccaccucgcccccgccgucuucccccccggcuucggcgaggucauccucuacuucuacuccaccuuccccggcuccggccaguccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 13634 - RNA, 1620 nt, Artificial Sequence
  derived and/or modified sequence opt2 from VP1_capsid_protein__Norovirus__AGL98413
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccgcgucggcaccucccacgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccgacaacgacuuccagaccggccagaacaccaaguucacccccgucggcgucauccaggacggcgaccaccaccagaacgagccccagcaguggguccuccccaacuacuccggcaccuccggccacaacguccaccucgcccccgccgucgcccccgccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcgcccucuga

SEQ ID NO: 13635 - RNA, 1620 nt, Artificial Sequence
  derived and/or modified sequence opt2 from VP1_capsid_protein__Norovirus__AGL98414
augaagauggccuccuccgacgccaaccccuccgacggcuccuccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucucccccgaccucaaccccuaccucucccaccucucccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggccaacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagcgccucuucaccggccccuccaccgccuucgucguccagccccagaacggccgcugcaccaccgacggcguccuccucggcaccacccagcucuccgccgucaacaucugcaacuuccgcggcgaggucaaccacaucgccggcacccacgacuacaccaugcgccucaccucccagaacuggaacaacuacgaccccaccgaggagauccccgccccccucggcacccccgacuucgucggccgcauccagggcguccucacccagaccacccgcuccgacggcuccacccgcucccacaaggccaccgucuccaccggcuccguccacuucacccccaagcucggcuccguccaguucaccaccgacaccaccaacgaccucaacgccggccagaacaccaaguucacccccgucggcgucgagcagaccuccggcgaccaccaguccgagccccagcaguggacccuccccaacuacuccggcacccccaaccacaacguccaccucgcccccgccgucgcccccaccuuccccggcgagcagcuccucuucuuccgcuccacccuccccggcugcggcggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccaccgcuccggcuucaucaccgucgcccacuccggcucccacgaccucgucaucccccccaacggcuacuuccgcuucgacuccugggucaaccaguucuacacccucgcccccaugggcaacggcuccggccgccgccgcgucgucuga

SEQ ID NO: 13636 - RNA, 1617 nt, Artificial Sequence
  derived and/or modified sequence opt2 from VP1_capsid_protein__Norovirus__AGL98416
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccaugccccucucccccgagcucaaccccuaccucucccaccucucccgcauguacaacggcuacgccggcggcuucgagguccaggucauccucgccggcaacgccuucaccgccggcaagaucaucuucgccgccaucccccccaacuuccccaccgacggccucucccccucccaggucaccauguucccccacaucaucgucgacguccgccagcucgagcccguccucaucccccuccccgacguccgcaacaacuucuaccacuacaaccaggccaacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgacgagaugaccaacucccgcuuccccaccccccucgagaagcuccacaccggccccaacaacuccaucgucguccagccccagaacggccgcugcaccaucgacggcguccuccucggcaccacccagcucuccaccgucaacaucugcaacuuccgcggcuccaccacccgcgccggccagucccacgccuacaccaugaaccucgucucccagaacuggaacaacuacgaccccaccgaggagauccccgccccccucggcacccccgacuucgucggcaagaucgucggcaugcucucccagaccacccgcgagaacuccuccacccgcgcccacaaggccaccgucuccaccggcgacgcccacuucacccccaaguccggcuccguccucuucaccaccgacaccgacgaccuccagaacggccagaacacccgcuucacccccgucggcgucgcccaggacggcgagccccaccagaacgagccccagcaguggcgccuccccaacuacuccggcacccccggccacaacguccaccucgccccccccgucgcccccaccuuccccggcgagcagcuccucuucuuccgcuccaccaugcccggcugcggcggcuaccccaacauggaccucgacugccuccucccccaggaguggguccgccacuucuaccaggaggccgcccccgcccaguccgacgucgcccuccuccgcuucgucaaccccgacaccggccgcguccucuucgagugcaagcuccacaaggccggcuacaucaccgucucccacaccggccccuacgaccucgucaucccccccaacggcuacuuccgcuucgacuccugggucaaccaguucuacgcccucgcccccaugggcaccggcaccggccgccgccgcgcccucuga

SEQ ID NO: 13637 - RNA, 1629 nt, Artificial Sequence
  derived and/or modified sequence opt2 from VP1,_capsid_protein__Norovirus__BAL60749
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacguccccgccccccucggcguccccgacuuccagggccgcgucuucggcgucaucucccagcgcgacaagcagaacgccgccggccacaacgagcccgccaaccgcggccacgacgccgucguccccaccuacaccgcccaguacacccccaagcucggccagguccagaucggcaccuggcagaccgacgaccuccaggucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13638 - RNA, 1629 nt, Artificial Sequence
  derived and/or modified sequence opt2 from VP1,_capsid_protein__Norovirus__BAL60753
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacucccccggccacaacgagcccgccaaccgcggccacgacgccgucguccccaccuacaccucccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13639 - RNA, 1629 nt, Artificial Sequence; identical to SEQ ID NO: 13638
  derived and/or modified sequence opt2 from VP1,_capsid_protein__Norovirus__BAL60755

SEQ ID NO: 13640 - RNA, 1629 nt, Artificial Sequence
  derived and/or modified sequence opt2 from VP1,_capsid_protein__Norovirus__BAL60759
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggccacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacguccccgccccccucggcguccccgacuuccagggccgcgucuucggcgucaucucccagcgcgacaagcagaacgccgccggccacaacgagcccgccaaccgcggccacgacgccgucguccccaccuacaccgcccaguacacccccaagcucggccagguccagaucggcaccuggcagaccgacgaccuccaggucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13641 - RNA, 1629 nt, Artificial Sequence
  derived and/or modified sequence opt2 from VP1,_capsid_protein__Norovirus__BAL60767
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccaucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcaugcccgacuuccagggccgcgucuucggcaucaucucccagcgcgaccgccacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13642 - RNA, 1629 nt, Artificial Sequence
  derived and/or modified sequence opt2 from VP1,_capsid_protein__Norovirus__BAL60769
augaagauggccuccaacgacgccguccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgagcaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagguccagaucggcaccuggcagaccgacgaccucaccgacaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 13643 - RNA, 1629 nt, Artificial Sequence
  derived and/or modified sequence opt2 from VP1,_capsid_protein__Norovirus__BAL60771
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13644 - RNA, 1629 nt, Artificial Sequence
  derived and/or modified sequence opt2 from VP1,_capsid_protein__Norovirus__BAL60773
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13645 - RNA, 1629 nt, Artificial Sequence
  derived and/or modified sequence opt2 from VP1,_capsid_protein__Norovirus__BAL60775
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccaucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13646 - RNA, 1629 nt, Artificial Sequence; identical to SEQ ID NO: 13645
  derived and/or modified sequence opt2 from VP1,_capsid_protein__Norovirus__BAL60777

SEQ ID NO: 13647 - RNA, 1629 nt, Artificial Sequence; identical to SEQ ID NO: 13645
  derived and/or modified sequence opt2 from VP1,_capsid_protein__Norovirus__BAL60779

SEQ ID NO: 13648 - RNA, 1629 nt, Artificial Sequence
  derived and/or modified sequence opt2 from VP1,_capsid_protein__Norovirus__BAL60781
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcaucgucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaucgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13649 - RNA, 1629 nt, Artificial Sequence
  derived and/or modified sequence opt2 from VP1,_capsid_protein__Norovirus__BAL60783
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgagcaccucuacaacgucaccaucaucaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccaacaaccagcccgucaaguucacccccgucggccucaacgacaccgagcacuucgaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 13650 - RNA, 1629 nt, Artificial Sequence
  derived and/or modified sequence opt2 from VP1,_capsid_protein__Norovirus__BAL60785
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccaucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcaucaucucccagcgcgacaagcacaacucccccggccagaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13651 - RNA, 1629 nt, Artificial Sequence; identical to SEQ ID NO: 13645
  derived and/or modified sequence opt2 from VP1,_capsid_protein__Norovirus__BAL60791

SEQ ID NO: 13652 - RNA, 1629 nt, Artificial Sequence; identical to SEQ ID NO: 13645
  derived and/or modified sequence opt2 from VP1,_capsid_protein__Norovirus__BAL60793

SEQ ID NO: 13653 - RNA, 1629 nt, Artificial Sequence; identical to SEQ ID NO: 13645
  derived and/or modified sequence opt2 from VP1,_capsid_protein__Norovirus__BAL60795

SEQ ID NO: 13654 - RNA, 1629 nt, Artificial Sequence; identical to SEQ ID NO: 13645
  derived and/or modified sequence opt2 from VP1,_capsid_protein__Norovirus__BAL60797

SEQ ID NO: 13655 - RNA, 1629 nt, Artificial Sequence
  derived and/or modified sequence opt2 from VP1,_capsid_protein__Norovirus__BAL60799
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaacuucacccccgccggccucuccgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 13656 - RNA, 1629 nt, Artificial Sequence; identical to SEQ ID NO: 13645
  derived and/or modified sequence opt2 from VP1,_capsid_protein__Norovirus__BAL60801

SEQ ID NO: 13657 - RNA, 1629 nt, Artificial Sequence; identical to SEQ ID NO: 13645
  derived and/or modified sequence opt2 from VP1,_capsid_protein__Norovirus__BAL60803

SEQ ID NO: 13658 - RNA, 1629 nt, Artificial Sequence
  derived and/or modified sequence opt2 from VP1,_capsid_protein__Norovirus__BAL60805
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggccacgccggcggcauggagguccaggucaugcucgccggcaacgccuucaccgccggcaagcucgucuucgccgccguccccccccacuuccccaucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13659 - RNA, 1629 nt, Artificial Sequence
  derived and/or modified sequence opt2 from VP1,_capsid_protein__Norovirus__BAL60809
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaacuucacccccgucggccucuccgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 13660 - RNA, 1629 nt, Artificial Sequence
  derived and/or modified sequence opt2 from VP1,_capsid_protein__Norovirus__BAL60811
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcgaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13661 - RNA, 1629 nt, Artificial Sequence; identical to SEQ ID NO: 13660
  derived and/or modified sequence opt2 from VP1,_capsid_protein__Norovirus__BAL60813

SEQ ID NO: 13662 - RNA, 1629 nt, Artificial Sequence; identical to SEQ ID NO: 13659
  derived and/or modified sequence opt2 from VP1,_capsid_protein__Norovirus__BAL60815

SEQ ID NO: 13663 - RNA, 1629 nt, Artificial Sequence
  derived and/or modified sequence opt2 from VP1,_capsid_protein__Norovirus__BAL60817
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccaucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucgcccccgucggccucaacgacaccgagcacuucaaccagugggucgucccccgcuacgccggcgcccucaaccucaacaucaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13664 - RNA, 1629 nt, Artificial Sequence; identical to SEQ ID NO: 13645
  derived and/or modified sequence opt2 from VP1,_capsid_protein__Norovirus__BAL60819

SEQ ID NO: 13665 - RNA, 1629 nt, Artificial Sequence; identical to SEQ ID NO: 13645
  derived and/or modified sequence opt2 from VP1,_capsid_protein__Norovirus__BAL60821

SEQ ID NO: 13666 - RNA, 1629 nt, Artificial Sequence
  derived and/or modified sequence opt2 from VP1,_capsid_protein__Norovirus__BAL60823
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggccucgagguccaggucaugcucgccggcaacgccuucaccgccggcaagcucgucuucgccgccguccccccccacuuccccaucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13667 - RNA, 1629 nt, Artificial Sequence
  derived and/or modified sequence opt2 from VP1,_capsid_protein__Norovirus__BAL60825
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaaguccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaacuucacccccgucggccucuccgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 13668 - RNA, 1629 nt, Artificial Sequence; identical to SEQ ID NO: 13645
  derived and/or modified sequence opt2 from VP1,_capsid_protein__Norovirus__BAL60827

SEQ ID NO: 13669 - RNA, 1629 nt, Artificial Sequence; identical to SEQ ID NO: 13645
  derived and/or modified sequence opt2 from VP1,_capsid_protein__Norovirus__BAL60829

SEQ ID NO: 13670 - RNA, 1629 nt, Artificial Sequence; identical to SEQ ID NO: 13645
  derived and/or modified sequence opt2 from VP1,_capsid_protein__Norovirus__BAL60831

SEQ ID NO: 13671 - RNA, 1629 nt, Artificial Sequence
  derived and/or modified sequence opt2 from VP1,_capsid_protein__Norovirus__BAL60833
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaacuucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 13672 - RNA, 1629 nt, Artificial Sequence
  derived and/or modified sequence opt2 from VP1,_capsid_protein__Norovirus__BAL60835
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgccaacuucacccccgucggccucuccgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 13673 - RNA, 1629 nt, Artificial Sequence; identical to SEQ ID NO: 13659
  derived and/or modified sequence opt2 from VP1,_capsid_protein__Norovirus__BAL60837

SEQ ID NO: 13674 - RNA, 1629 nt, Artificial Sequence; identical to SEQ ID NO: 13659
  derived and/or modified sequence opt2 from VP1,_capsid_protein__Norovirus__BAL60839

SEQ ID NO: 13675 - RNA, 1629 nt, Artificial Sequence
  derived and/or modified sequence opt2 from VP1,_capsid_protein__Norovirus__BAL60841
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaccuccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 13676 - RNA, 1629 nt, Artificial Sequence; identical to SEQ ID NO: 13645
  derived and/or modified sequence opt2 from VP1,_capsid_protein__Norovirus__BAL60843

SEQ ID NO: 13677 - RNA, 1629 nt, Artificial Sequence; identical to SEQ ID NO: 13671
  derived and/or modified sequence opt2 from VP1,_capsid_protein__Norovirus__BAL60845

SEQ ID NO: 13678 - RNA, 1629 nt, Artificial Sequence; identical to SEQ ID NO: 13659
  derived and/or modified sequence opt2 from VP1,_capsid_protein__Norovirus__BAL60847

SEQ ID NO: 13679 - RNA, 1629 nt, Artificial Sequence
  derived and/or modified sequence opt2 from VP1,_capsid_protein__Norovirus__BAL60849
augaagauggccuccaacgacgccgcccccuccaccgacggcgccgccggccucguccccgaguccaacuccgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccaucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 13680 - RNA, 1629 nt, Artificial Sequence; identical to SEQ ID NO: 13645
  derived and/or modified sequence opt2 from VP1,_capsid_protein__Norovirus__BAL60851

SEQ ID NO: 13681 - RNA, 1647 nt, Artificial Sequence
  derived and/or modified sequence opt2 from VP1__Norovirus__AAT00378
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgucaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucgcccccgucggcaucggcgucgaccgcgaggccggcuuccagcaguggucccuccccgacuacuccggccaguucucccgcaucaugucccucgcccccgccgucgcccccaucuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 13682 - RNA, 1626 nt, Artificial Sequence
  derived and/or modified sequence opt2 from VP1__Norovirus__ABD95934
augaagauggccuccaacgacgccgcccccuccaacgacggcgccgccggccucguccccgagaucaacaccgagacccucccccucgagcccgucgccggcgccgcccucgccgccgccgucaccggccaguccaacaucaucgaccccuggauccgcaccaacuucguccaggcccccaacggcgaguucaccgucuccccccgcaacucccccggcgagguccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccgccccuccgagcgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucaccaucuccgagcucaccaacucccgcuuccccgcccccaucgacucccucuucaccgcccagaacaacaaccucaacguccagugccagaacggccgcugcacccucgacggcgagcuccagggcaccacccagcuccuccccaccggcaucugcgccuuccgcggcaagaucuccgccgacguccagaacucccaccaggaccgcuggcacaugcagcucaccaaccucaacggcacccccuucgaccccaccgacgacguccccgccccccucggcacccccgacuucaccggccuccucuucggcgucgccucccagcgcaacgucggcggcaccggcaacaacaccacccgcgcccacgaggucgucaucgccaccaccuccacccaguucguccccaagcucggcuccaucaacuucggcuccgaguccgaggacuuccaggucggcccccccaccaaguucacccccgucggcaucaagaucgagaccggccacuccuuccgccagugggacccccccaacuacuccggcgcccucacccucaacaugaaccucgccccccccgucgcccccaacuuccccggcgagcagcuccucuucuuccgcuccaacguccccugcgccggcggcgucuccgagggcaucaucgacugccuccucccccaggaguggauccagcacuucuaccaggaguccgcccccucccaguccgacgucgcccucauccgcuacgucaaccccgacaccggccgcacccucuucgaggccaagcuccaccgcaccggcuacaucaccgucgcccacuccggcgacuacccccucgucguccccuccaacggcuacuuccgcuucgacuccuggaucaaccaguucuacucccucgcccccaugggcaccggcaacggccgccgccgcguccaguga

SEQ ID NO: 13683 - RNA, 1623 nt, Artificial Sequence
  derived and/or modified sequence opt2 from VP1__Norovirus__ABG49509
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccgacacccacaacuacaccaugaaccucgccucccagaacuggaacaacuacgaccccaccgaggagauccccgccccccucggcacccccgacuucgucggcaagauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13684 - RNA, 1623 nt, Artificial Sequence
  derived and/or modified sequence opt2 from VP1__Norovirus__ABP88833
augaagauggccaccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgaggucgaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaucuccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccccuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguccuacacccucgcccccaugggcaacggcgccggccgccgccgcgcccucuga

SEQ ID NO: 13685 - RNA, 1623 nt, Artificial Sequence
  derived and/or modified sequence opt2 from VP1__Norovirus__ABY27560
augaagauggccuccuccgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucaccaccgacaccaacaacgaccucgagaccggccagaacaccaaguucacccccgucggcgucguccaggacggcaacuccgcccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 13686 - RNA, 1620 nt, Artificial Sequence
  derived and/or modified sequence opt2 from VP1__Norovirus__ACT76139
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccgcgucggcaucucccacgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggcaccuccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcgcccucuga

SEQ ID NO: 13687 - RNA, 1620 nt, Artificial Sequence
  derived and/or modified sequence opt2 from VP1__Norovirus__ACT76142
augaagauggccuccuccgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucucccccgaccucaaccccuaccucucccaccucucccgcauguacaacggcuacgccggcggcuucgagguccaggucauccucgccggcaacgccuucaccgccggcaagaucaucuucgccgccaucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccgcgucggcaucucccacgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggcaccuccggccacaacguccaccucgcccccgccgucgcccccaccuuccccggcgagcagcuccucuucuuccgcuccaccaugcccggcugcuccggcuaccccaacaugaaccucgacugccuccucccccaggagugggucucccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcuccggccgcaagcgcguccucuga

SEQ ID NO: 13688 - RNA, 1620 nt, Artificial Sequence
  derived and/or modified sequence opt2 from VP1__Norovirus__ACT76145
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagucccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgucucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcgcccucuga

SEQ ID NO: 13689 - RNA, 1620 nt, Artificial Sequence
  derived and/or modified sequence opt2 from VP1__Norovirus__ACT76148
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgucucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucauccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccguccccggcugcuccggcuaccccaacaugaaccucgacugccuccucccccaggagugggucucccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucguccucccccccaacggcuacuuccgcuucgacuccugggucaaccaguucuacacccucgcccccaugggcaacggcaccggccgccgccgcgcccucuga

SEQ ID NO: 13690 - RNA, 1620 nt, Artificial Sequence
  derived and/or modified sequence opt2 from VP1__Norovirus__ACT76151
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaggcccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccgcgucggcaucucccacgacuacaccaugaaccucgucucccagaacuggaacaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggcaccuccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuacgaccucgucaucccccccaacggcuacuuccgcuucgacuccugggucaaccaguucuacacccucgcccccaugggcaacggcaccggccgccgccgcgcccucuga

SEQ ID NO: 13691 - RNA, 1623 nt, Artificial Sequence
  derived and/or modified sequence opt2 from VP1__Norovirus__ACX31821
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccgucuucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13692 - RNA, 1623 nt, Artificial Sequence
  derived and/or modified sequence opt2 from VP1__Norovirus__ACX31837
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13693 - RNA, 1623 nt, Artificial Sequence
  derived and/or modified sequence opt2 from VP1__Norovirus__ACX31841
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13694 - RNA, 1623 nt, Artificial Sequence
  derived and/or modified sequence opt2 from VP1__Norovirus__ACX31851
augaagauggccuccaacgacgccaaccccuccaacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13695 - RNA, 1623 nt, Artificial Sequence
  derived and/or modified sequence opt2 from VP1__Norovirus__ACX31856
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucauccccuccaacggcuacuuccgcuucgacuccugggucaaccaguucuacacccucgcccccaugggcaacggcaccggccgccgccgcguccucuga

SEQ ID NO: 13696 - RNA, 1623 nt, Artificial Sequence
  derived and/or modified sequence opt2 from VP1__Norovirus__ACX31860
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccgagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13697 - RNA, 1623 nt, Artificial Sequence
  derived and/or modified sequence opt2 from VP1__Norovirus__ACX31864
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgacaugaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucgccaaccagaacaccaaguucacccccgucggcgucauccaggacggcaacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13698 - RNA, 1623 nt, Artificial Sequence
  derived and/or modified sequence opt2 from VP1__Norovirus__ACX31889
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgacaugaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13699 - RNA, 1608 nt, Artificial Sequence
  derived and/or modified sequence opt2 from VP1__Norovirus__ACX31893
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagcagcgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgaguccgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 13700 - RNA, 1749 nt, Artificial Sequence
  derived and/or modified sequence opt2 from VP1__Norovirus__ACX69259
augaagauggccuccaacgacgccgccccccccuccuccgacggcgccgccaaccucguccccgagaucaacaacgaggucauggcccucgagcccgucgccggcgcccagcucgccgcccccgucgccggccaguucaacgccaucgaccccuggauccgccagaacuucguccaggcccccgagggcgaguucaccgucuccccccgcaacgcccccggcgagauccuccucaaccucgagcucggcccccaccucaaccccuuccuccagcaccucgcccagauguacaacgccuacgccggcggcauggagguccaggucguccucgccggcaacgccuucaccgccggcaagaucaucuucgccgccauccccccccacuucccccccgagcgccucuccgccgcccaggccacccaguucccccacgucaucgucgacguccgccagcucgagcccaucguccucccccuccccgacguccgccacaaccucuuccacuucaaccagcagaacgacgagcgcaugcaccucgucgccuuccucuacaccccccuccgcgccaacuccggcaacggcgacgacgucuucaccgucuccugccgcguccucacccgccccucccaggacuucgaguucauguuccucgucccccccaccgucgagaagaagaccgucgccuucucccucccccagcucgccgucggcgagauguccaacucccgcuggcccgcccgcaucaccggcauggucgucgacccccgccucccccagguccuccacauccagaacggccgcugcacccucgacggcacccucaugggcaccacccagcucaaccccaacgacaucugccgcauccgcggcuacuucuccuccucccgccccgagcuccucugcgagggcgaggaguccgaggucaacaccacccccaccgacuccggcgccaccggcgaccagacccccgagguccgcaccggcacccgcgccacccagcgcugguucgccgucaccgagcucaacggccaggucuacgaccccuucggcgaccagcccgccccccucggcguccccgacuucaaggcccgcauccucggcgcccucaugcgccuccccggcaccaaccccaccuccaacucccgcuucgaggacgccugggucgagaccaacaaccagaccaccuacgcccccgccaccggcgucgucgccaucaccaccaacgacaacuccuccggcaacuacgccaacgaccagaccugcgaguucgucccccucggcaucgagaucaccgacuccgcccccuacaacgaguucgaccuccccuccuacggcggcgccgccuccuccggcaaccgcaaccucgcccccaccgucgcccccaccuuccccggcgaggccauccuccucuucggcuccaacaugcccgucuacaaccgcuccuccggcaccgacaacaaggacauccgcugccuccuccccaacgaguacguccagcaccucuacgacacccaggcccccucccucuccgacgucgcccucguccgcuacgucaaccgcgacaccggccgcguccucuucgaggccaagcuccaccgcgacggcuucaugaccgucaacgccuccuccaccaccguccuccccgucgacggcuacuuccgcuucgacuccugggucaaccaguucuacgcccucucccccgucggcaacgccuccggccgccgcggccgcucccgccaggccaacuga

SEQ ID NO: 13701 - RNA, 1647 nt, Artificial Sequence
  derived and/or modified sequence opt2 from VP1__Norovirus__ADF47131
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucaaccagaaccagcccacccgcuucacccccgucggcaucggcgucgaccacgaggaggacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccacccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaccggcaccgagaacggccgccgccgcguccaguga

SEQ ID NO: 13702 - RNA, 1623 nt, Artificial Sequence
  derived and/or modified sequence opt2 from VP1__Norovirus__ADR78869
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13703 - RNA, 1623 nt, Artificial Sequence
  derived and/or modified sequence opt2 from VP1__Norovirus__ADR78872
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucacccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13704 - RNA, 1623 nt, Artificial Sequence; identical to SEQ ID NO: 13702
  derived and/or modified sequence opt2 from VP1__Norovirus__ADR78875

SEQ ID NO: 13705 - RNA, 1623 nt, Artificial Sequence; identical to SEQ ID NO: 13702
  derived and/or modified sequence opt2 from VP1__Norovirus__ADR78878

SEQ ID NO: 13706 - RNA, 1623 nt, Artificial Sequence; identical to SEQ ID NO: 13702
  derived and/or modified sequence opt2 from VP1__Norovirus__ADR78881

SEQ ID NO: 13707 - RNA, 1623 nt, Artificial Sequence; identical to SEQ ID NO: 13702
  derived and/or modified sequence opt2 from VP1__Norovirus__ADR78884

SEQ ID NO: 13708 - RNA, 1623 nt, Artificial Sequence
  derived and/or modified sequence opt2 from VP1__Norovirus__ADR78887
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugucccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13709 - RNA, 1623 nt, Artificial Sequence; identical to SEQ ID NO: 13702
  derived and/or modified sequence opt2 from VP1__Norovirus__ADR78890

SEQ ID NO: 13710 - RNA, 1623 nt, Artificial Sequence; identical to SEQ ID NO: 13702
  derived and/or modified sequence opt2 from VP1__Norovirus__ADR78893

SEQ ID NO: 13711 - RNA, 1623 nt, Artificial Sequence; identical to SEQ ID NO: 13702
  derived and/or modified sequence opt2 from VP1__Norovirus__ADR78896

SEQ ID NO: 13712 - RNA, 1623 nt, Artificial Sequence
  derived and/or modified sequence opt2 from VP1__Norovirus__ADR78899
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcgcccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13713 - RNA, 1623 nt, Artificial Sequence; identical to SEQ ID NO: 13702
  derived and/or modified sequence opt2 from VP1__Norovirus__ADR78902

SEQ ID NO: 13714 - RNA, 1623 nt, Artificial Sequence; identical to SEQ ID NO: 13702
  derived and/or modified sequence opt2 from VP1__Norovirus__ADR78905

SEQ ID NO: 13715 - RNA, 1623 nt, Artificial Sequence
  derived and/or modified sequence opt2 from VP1__Norovirus__ADR78908
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13716 - RNA, 1623 nt, Artificial Sequence
  derived and/or modified sequence opt2 from VP1__Norovirus__ADR78911
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccagcucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13717 - RNA, 1623 nt, Artificial Sequence
  derived and/or modified sequence opt2 from VP1__Norovirus__ADR78914
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13718 - RNA, 1623 nt, Artificial Sequence
  derived and/or modified sequence opt2 from VP1__Norovirus__ADR78917
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggccgcauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13719 - RNA, 1623 nt, Artificial Sequence
  derived and/or modified sequence opt2 from VP1__Norovirus__ADR78920
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcgacaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13720 - RNA, 1623 nt, Artificial Sequence
  derived and/or modified sequence opt2 from VP1__Norovirus__ADR78923
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13721 - RNA, 1623 nt, Artificial Sequence
  derived and/or modified sequence opt2 from VP1__Norovirus__ADR78929
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13722 - RNA, 1623 nt, Artificial Sequence
  derived and/or modified sequence opt2 from VP1__Norovirus__ADR78932
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13723 - RNA, 1623 nt, Artificial Sequence
  derived and/or modified sequence opt2 from VP1__Norovirus__ADR78938
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcuccuaccgcaugaaccucgccucccagaacuggaacaacuacgaccccaccgaggagauccccgccccccucggcacccccgacuucgucggcaagauccagggcaugcucacccagaccaccaagcgcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13724 - RNA, 1623 nt, Artificial Sequence; identical to SEQ ID NO: 13565
  derived and/or modified sequence opt2 from VP1__Norovirus__ADR78941

SEQ ID NO: 13725 - RNA, 1623 nt, Artificial Sequence
  derived and/or modified sequence opt2 from VP1__Norovirus__ADR78944
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13726 - RNA, 1623 nt, Artificial Sequence; identical to SEQ ID NO: 13565
  derived and/or modified sequence opt2 from VP1__Norovirus__ADR78947

SEQ ID NO: 13727 - RNA, 1623 nt, Artificial Sequence
  derived and/or modified sequence opt2 from VP1__Norovirus__ADR78950
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagguccuccucgccggcaacgccuucaccgccggcaagaucaucuucgccgccgucccccccaccuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucgucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucaccaacauccccggcucccgcaccuaccgcaugaaccucgccucccagaacuggaacaacuacgaccccaccgaggagauccccgccccccucggcacccccgacuucgucggcaagauccagggcguccucacccagaccaccaagggcgacggcuccacccgcggccacaaggccaccguccgcaccggcuccgccgacuucacccccaagcucggcuccguccaguucgccaccgacaccgacaacgacuucgucaccggccagaacacccgcuucacccccgucggcgucauccacgacggcuccuccgcccaccgcaacgagccccagcaguggguccuccccgaguacuccggccgcuccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13728 - RNA, 1623 nt, Artificial Sequence
  derived and/or modified sequence opt2 from VP1__Norovirus__ADR78956
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13729 - RNA, 1653 nt, Artificial Sequence
  derived and/or modified sequence opt2 from VP1__Norovirus__AEA02124
augaugauggccuccaaggacgccaccuccaacauggacggcaccuccggcgccggccagcucguccccgagaacaacaacaccuccgagcccaucaacauggagcccgucgccggcgccgucaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucgcccaccucucccagauguacaacggcugggucggcaacaugaagguccgcgucguccucgccggcaacgccuucuccgccggcaagaucaucgucugcugcaucccccccggcuucuccgcccccaacaucuccaucgcccaggccaccauguucccccacgucaucgccgacguccgcguccucgagcccaucgacaucccccucgacgacguccgcaacguccucuuccacaccaacgacaacggcaaccagaccaugcgccuccucugcaugcucuacaccccccuccgcuccggcggcaccuccuccggcaccgaccccuucgucaucgccggccgcguccucaccugccccacccccgacuucaacuuccucuuccucgucccccccaccgucgagcagaagaccaagcaguucuccguccccaaccucccccucaacgucauguccaacucccgcguccccucccuccucaacgccauggucgucucccccgaccaggcccaggucguccaguuccagaacggccgcugcacccucgacggccagaugcucggcaccaccaccgucuccgccuccugcgucgcccgcuuccgcggcaagaccuuccaggcccccgacaaccgccucggcaucaaccucgccgagaucuccggcgagcccuaccacgccuucgagucccccgccccccucggcuuccccgacuucggcgacggcgacuggcacgucaccgccaccaaggucacccccucccagcucgaggccaacgaccccgucgucgucggcaacguccagcccuacaacccccaguucgccccccaccucggcacccucgucgucgagaaccccacccccgaccaggucgccaccggcaccgaccuccucuucaacaucaccuggcucuccaaccgcgccaacaaccgcuucaaccccugggucauccccaacuacggcuccacccucaccgaggccgcccagcucgcccccuccaucuucccccccggcuucggcgagaccaucgucuacuucaacuccaccuuccccgccgucggcgccaccacccacgccgccauccccugccuccucccccaggaguucgucgcccacuucgucaacgagcaggcccccauccgcggcgaggccgcccuccuccacuacaucgaccccgacacccaccgcaaccucggcgaguucaagaucuaccccgagggcuucgucaccugcguccccaacgucggcggcaccggcccccagucccuccccaccaacggcgucuucgucuucgucuccugggucucccgcuacuaccagcucaagcccgucggcaccgccggccaggcccgccgccucggcuuccgccgcgucuga

SEQ ID NO: 13730 - RNA, 1647 nt, Artificial Sequence
  derived and/or modified sequence opt2 from VP1__Norovirus__AED02033
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucauccgcuccaccucccgcgccuccgaccaggccgacaccuccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucaucaccgaguccgacgacuucgaccucaaccaguccaccaaguucacccccgucggcaucggcgucgacaacgaggccgaguuccagcaguggucccuccccaacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 13731 - RNA, 1647 nt, Artificial Sequence
  derived and/or modified sequence opt2 from VP1__Norovirus__AED02034
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccucaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacaccgccaccccccgccucuucaacuacuacuggcacauccagcucaacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucgcccccaagcucggcucccucgagaucuccaccgagaccgacgacuucaaccagaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccuccggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 13732 - RNA, 1647 nt, Artificial Sequence
  derived and/or modified sequence opt2 from VP1__Norovirus__AED02035
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcaccggcgaccaggccgacaccgccuccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucgcccccaagcucggcucccucgagaucuccaccgaguccgacgacuucgacuccaaccagcccacccgcuucacccccgucggcaucggcgucgaccgcgagaccgacuuccagcaguggacccuccccgaguacuccggccaguucacccacaacaugaaccucgcccccgccgucgcccccaacuuccccggcgagcagcuccucuucuuccgcucccagcuccccuccuccggcggccgcuccggcggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 13733 - RNA, 1647 nt, Artificial Sequence
  derived and/or modified sequence opt2 from VP1__Norovirus__AED02037
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgaguccaucgucguccagugccagaacggccgcgucacccucgacggcgagcucaugggcaccacccagcuccuccccaaccagaucugcgccuuccgcggcacccucacccgcuccaccaaccgcgccuccgaccaggccgacaccgccaccccccgccucuucaaccaccacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucaccaccgaguccgacgacuucgaccccaaccaguccaccaaguucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 13734 - RNA, 1647 nt, Artificial Sequence
  derived and/or modified sequence opt2 from VP1__Norovirus__AED02038
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccggcgaccaggccgacaccgccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucgcccccaagcucggcucccucgagaucuccaccgaguccuccgacuucgacuccaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 13735 - RNA, 1647 nt, Artificial Sequence
  derived and/or modified sequence opt2 from VP1__Norovirus__AED02039
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccggcgaccaggccgacaccgccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucgcccccaagcucggcucccucgagaucuccaccgaguccuccgacuucgacuccaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcucccacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacaagcgccgccgcauccaguga

SEQ ID NO: 13736 - RNA, 1623 nt, Artificial Sequence
  derived and/or modified sequence opt2 from VP1__Norovirus__AEG79290
augaagauggccuccaacgacgccaaccccuccgacggcuccgccgccaaccucguccccgaggucaacaacgaggucauggcccucgagcccgucgccggcgccgcccucgccgcccccgucgccggccagcagaacgucaucgaccccuggauccgcaacaacuucguccaggcccccggcggcgaguucaccgucuccccccgcaacgcccccggcgagauccucugguccgccccccucucccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgagcccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccuccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccuccaucaacuggaacaacuacgaccccaccgaggagauccccgccccccucggcacccccgacuucgucggcaagauccagggcaugcucacccagaccacccgcggcgacggcuccacccgcggccaccgcgccaccgucuacaccggcuccgcccccuucacccccaagcucggcuccguccaguucaccaccgacaccgacaacgacuucgagaccaaccagaacaccaaguucacccccgucggcgucguccaggacggcgacaccgcccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13737 - RNA, 1608 nt, Artificial Sequence
  derived and/or modified sequence opt2 from VP1__Norovirus__AEI29586
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucgacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgaguccgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 13738 - RNA, 1623 nt, Artificial Sequence
  derived and/or modified sequence opt2 from VP1__Norovirus__AEJ82646
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgucuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgccccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccauccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13739 - RNA, 1623 nt, Artificial Sequence
  derived and/or modified sequence opt2 from VP1__Norovirus__AER11308
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13740 - RNA, 1623 nt, Artificial Sequence
  derived and/or modified sequence opt2 from VP1__Norovirus__AER11310
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccgucaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13741 - RNA, 1623 nt, Artificial Sequence
  derived and/or modified sequence opt2 from VP1__Norovirus__AER11312
augaagaucgccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccuccacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13742 - RNA, 1623 nt, Artificial Sequence
  derived and/or modified sequence opt2 from VP1__Norovirus__AER11314
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13743 - RNA, 1623 nt, Artificial Sequence; identical to SEQ ID NO: 13702
  derived and/or modified sequence opt2 from VP1__Norovirus__AER11316

SEQ ID NO: 13744 - RNA, 1623 nt, Artificial Sequence; identical to SEQ ID NO: 13702
  derived and/or modified sequence opt2 from VP1__Norovirus__AER11318

SEQ ID NO: 13745 - RNA, 1623 nt, Artificial Sequence
  derived and/or modified sequence opt2 from VP1__Norovirus__AER11320
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13746 - RNA, 1623 nt, Artificial Sequence; identical to SEQ ID NO: 13702
  derived and/or modified sequence opt2 from VP1__Norovirus__AER11324

SEQ ID NO: 13747 - RNA, 1623 nt, Artificial Sequence
  derived and/or modified sequence opt2 from VP1__Norovirus__AER11326
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuaccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13748 - RNA, 1623 nt, Artificial Sequence; identical to SEQ ID NO: 13715
  derived and/or modified sequence opt2 from VP1__Norovirus__AER11328

SEQ ID NO: 13749 - RNA, 1623 nt, Artificial Sequence
  derived and/or modified sequence opt2 from VP1__Norovirus__AER11330
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagacccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13750 - RNA, 1623 nt, Artificial Sequence; identical to SEQ ID NO: 13250
  derived and/or modified sequence opt2 from VP1__Norovirus__AER11332

SEQ ID NO: 13751 - RNA, 1623 nt, Artificial Sequence; identical to SEQ ID NO: 13715
  derived and/or modified sequence opt2 from VP1__Norovirus__AER11334

SEQ ID NO: 13752 - RNA, 1623 nt, Artificial Sequence
  derived and/or modified sequence opt2 from VP1__Norovirus__AER11336
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucaacaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13753 - RNA, 1623 nt, Artificial Sequence
  derived and/or modified sequence opt2 from VP1__Norovirus__AER11340
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13754 - RNA, 1623 nt, Artificial Sequence; identical to SEQ ID NO: 13753
  derived and/or modified sequence opt2 from VP1__Norovirus__AER11342

SEQ ID NO: 13755 - RNA, 1623 nt, Artificial Sequence
  derived and/or modified sequence opt2 from VP1__Norovirus__AER11344
augaagauggccuccaacgacgccucccccuccgacggcuccgccgccaaccucguccccgaggucaacaacgaggucauggcccucgagcccgucgucggcgccgccaucgccgcccccgucgccggccagaagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13756 - RNA, 1623 nt, Artificial Sequence; identical to SEQ ID NO: 13753
  derived and/or modified sequence opt2 from VP1__Norovirus__AER11346

SEQ ID NO: 13757 - RNA, 1623 nt, Artificial Sequence
  derived and/or modified sequence opt2 from VP1__Norovirus__AER11348
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucuccuccucccaggucaccauguucccccacaucaucgucgacguccgccagcucgagcccguccucaucccccuccccgacguccgcaacaacuucuaccacuacaaccaguccuccgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13758 - RNA, 1623 nt, Artificial Sequence
  derived and/or modified sequence opt2 from VP1__Norovirus__AER11350
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcgucuuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13759 - RNA, 1623 nt, Artificial Sequence
  derived and/or modified sequence opt2 from VP1__Norovirus__AER11352
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcggcaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13760 - RNA, 1623 nt, Artificial Sequence
  derived and/or modified sequence opt2 from VP1__Norovirus__AER11354
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcuccaccacccaccgcaacgagccccagcagugggucccccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13761 - RNA, 1623 nt, Artificial Sequence
  derived and/or modified sequence opt2 from VP1__Norovirus__AER11356
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13762 - RNA, 1623 nt, Artificial Sequence; identical to SEQ ID NO: 13252
  derived and/or modified sequence opt2 from VP1__Norovirus__AER11358

SEQ ID NO: 13763 - RNA, 1623 nt, Artificial Sequence
  derived and/or modified sequence opt2 from VP1__Norovirus__AER11360
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccaccucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13764 - RNA, 1647 nt, Artificial Sequence
  derived and/or modified sequence opt2 from VP1__Norovirus__AEX10549
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaccgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgacaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuaccacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccggcgacuucgaccagaaccagcccacccgcuucacccccgucggcaucggcgucgacaacgaggccgacuuccagcaguggacccuccccgacuacuccggccaguucacccacaacaugaaccucgcccccgccgucgcccccaacuuccccggcgagcagcuccucuucuuccgcucccaccuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaaguccggcgacucccccaucaccgucccccccaacggcuacuuccgcuucgaguccugggucaaccccuucuacacccucgcccccaugggcaccggcaacggccgccgccgcauccaguga

SEQ ID NO: 13765 - RNA, 1623 nt, Artificial Sequence
  derived and/or modified sequence opt2 from VP1__Norovirus__AEX91910
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagacccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13766 - RNA, 1737 nt, Artificial Sequence
  derived and/or modified sequence opt2 from VP1__Norovirus__AFD30970
augaagauggccuccuccgacgccacccccuccuccgacggcgccggcaaccucguccccgagucccagcaggagguccucccccucgcccccgucgccggcgccgcccucgccgcccccgucgucggccagcagaacaucaucgaccccuggaucaaggagaacuucguccaggccccccagggcgaguucaccgucucccccaagaacucccccggcgagguccucgucaaccucgagcucuccccccgccucaaccccuaccucgaccaccucuccaagauguacaacgccuacgccggcggcauggaggucgagaucauccucgccggcaacgccuucaccgccggcaagguccucaucgccgccgucccccccaacuuccccaucgagaacaucuccgccucccaggccucccaguucccccacgucaucgucgacguccgcacccucgagcccauccgccucccccuccccgacguccgcaccaacuucuuccacuacaccacccaggaggagccccgcaugcgcaucgucgccuggcucuacaccccccuccgcaccaacggcuccggcgacgacuccuucaccgucuccggccgcauccucacccgccccucccccgacuucgaguucuccuuccucgucccccccaccgucgagaccaagaccgucuccuucuccguccccggccucgucgucgaggacauguccaacucccgcuggcccgcccagaucaacggccucgucguccgcggcaacgaggcccaggucguccacuuccagaacggccgcugcaccaccgagggcacccuccucggcaccaccacccucuccaucaacuccaucugcggccuccgcggccucuccgucucccaggccuccguccgcggcgcccccgcccucaccgaggagaugcccccccucgaggacgaggucgccgacggcgccgccgccaccuacacccucgcccgcgccgccgacaccacccucuggcuccgcgucgaggagcccgacggccgccccuacgacaucuucggcgaccagcccgccccccucggcacccccgacuucaccgccgucaucgucggcaccgccauccgcccccgcaccgccuccggcgccuaccuccacgacgccuacgucgacaccacccccggcgacgccgacuucacccccuccaccggcaacaccaagaucguccuccgcggcggcggcuccggccacgucggccagggccacuacuggcaguuccgccccaucgccgucgagggcggcggcucccgcccccaguaccaggaguacaaccuccccgacuacgccggccccaccgccuccaaccacgaccucgccccccccgucgccccccgcaugcccggcgagcuccuccuccucuucgaguccgacaugcccgucugggacaacggcgccggcgccgcccccgcccagaagauccacugccuccuccccaacgaguucaucacccaccucuucgaccuccaggcccccgcccucgccgaggccgcccuccuccgcuacguccaccccgacuccggccgcacccucuucgagugcaagcucuaccgcgagggcuacauggucgucgccgcccccgccggccgccucaacuucccccucgacggcuacuuccgcuucgacuccugggucuccgccuucuacauccucucccccgucggcuccggccagggccgccgcggccgcuccaaggccgccuga

SEQ ID NO: 13767 - RNA, 1623 nt, Artificial Sequence
  derived and/or modified sequence opt2 from VP1__Norovirus__AFH88383
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccguccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccgacaacucccagcucaacgucuggaccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 13768 - RNA, 1671 nt, Artificial Sequence
  derived and/or modified sequence opt2 from VP1__Norovirus__AFJ21376
augaagauggccuccuccgacgccgcccccuccaccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccuccuccgaggccgacgagcgcgccgucggcuccuucgacgucuggguccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcaccggccacaucuccgccaacaaguacugggaguucaaguccuucggcgucgagggcgagcgccacaccgacauccaguaccaggaguacgagcuccccgacuacuccggccaggucgccuccaaccacaaccucgccccccccgucgccccccgcaugcccggcgagucccuccuccucuuccaguccaacaugcccgucugggacgacggccacggcgaguccacccccaagaagauccacugccuccucccccaggaguucaucggccacuucuucgaccgccaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcggccgcguccgcuuccaguga

SEQ ID NO: 13769 - RNA, 1608 nt, Artificial Sequence
  derived and/or modified sequence opt2 from VP1__Norovirus__AFJ21379
augaagauggccuccuccgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaugggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgacaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgaguccgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 13770 - RNA, 1608 nt, Artificial Sequence; identical to SEQ ID NO: 13458
  derived and/or modified sequence opt2 from VP1__Norovirus__AFJ21382

SEQ ID NO: 13771 - RNA, 1623 nt, Artificial Sequence
  derived and/or modified sequence opt2 from VP1__Norovirus__AFJ21387
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccaucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13772 - RNA, 1623 nt, Artificial Sequence; identical to SEQ ID NO: 13692
  derived and/or modified sequence opt2 from VP1__Norovirus__AFJ21388

SEQ ID NO: 13773 - RNA, 1623 nt, Artificial Sequence; identical to SEQ ID NO: 13702
  derived and/or modified sequence opt2 from VP1__Norovirus__AFJ21389

SEQ ID NO: 13774 - RNA, 1623 nt, Artificial Sequence
  derived and/or modified sequence opt2 from VP1__Norovirus__AFJ21390
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacgccaugaaccucgccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13775 - RNA, 1623 nt, Artificial Sequence
  derived and/or modified sequence opt2 from VP1__Norovirus__AFJ21391
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13776 - RNA, 1623 nt, Artificial Sequence
  derived and/or modified sequence opt2 from VP1__Norovirus__AFJ21392
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacgccugggucaaccaguucuacacccucgcccccaugggcaacggcaccggccgcaagcgcgcccucuga

SEQ ID NO: 13777 - RNA, 1623 nt, Artificial Sequence; identical to SEQ ID NO: 13715
  derived and/or modified sequence opt2 from VP1__Norovirus__AFJ21393

SEQ ID NO: 13778 - RNA, 1623 nt, Artificial Sequence; identical to SEQ ID NO: 13702
  derived and/or modified sequence opt2 from VP1__Norovirus__AFJ21394

SEQ ID NO: 13779 - RNA, 1623 nt, Artificial Sequence; identical to SEQ ID NO: 13715
  derived and/or modified sequence opt2 from VP1__Norovirus__AFJ21395

SEQ ID NO: 13780 - RNA, 1623 nt, Artificial Sequence; identical to SEQ ID NO: 13702
  derived and/or modified sequence opt2 from VP1__Norovirus__AFJ21396

SEQ ID NO: 13781 - RNA, 1623 nt, Artificial Sequence
  derived and/or modified sequence opt2 from VP1__Norovirus__AFJ21397
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgaccccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13782 - RNA, 1623 nt, Artificial Sequence
  derived and/or modified sequence opt2 from VP1__Norovirus__AFJ21398
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucauccccuccaacggcuacuuccgcuucgacuccugggucaaccaguucuacacccucgcccccaugggcaacggcaccggccgccgccgcgcccucuga

SEQ ID NO: 13783 - RNA, 1623 nt, Artificial Sequence
  derived and/or modified sequence opt2 from VP1__Norovirus__AFJ21399
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcaacaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13784 - RNA, 1623 nt, Artificial Sequence; identical to SEQ ID NO: 13782
  derived and/or modified sequence opt2 from VP1__Norovirus__AFJ21400

SEQ ID NO: 13785 - RNA, 1623 nt, Artificial Sequence
  derived and/or modified sequence opt2 from VP1__Norovirus__AFJ21401
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagacccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13786 - RNA, 1623 nt, Artificial Sequence
  derived and/or modified sequence opt2 from VP1__Norovirus__AFJ21402
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13787 - RNA, 1623 nt, Artificial Sequence; identical to SEQ ID NO: 13786
  derived and/or modified sequence opt2 from VP1__Norovirus__AFJ21403

SEQ ID NO: 13788 - RNA, 1623 nt, Artificial Sequence; identical to SEQ ID NO: 13786
  derived and/or modified sequence opt2 from VP1__Norovirus__AFJ21404

SEQ ID NO: 13789 - RNA, 1623 nt, Artificial Sequence
  derived and/or modified sequence opt2 from VP1__Norovirus__AFJ21405
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13790 - RNA, 1623 nt, Artificial Sequence; identical to SEQ ID NO: 13292
  derived and/or modified sequence opt2 from VP1__Norovirus__AFJ21406

SEQ ID NO: 13791 - RNA, 1623 nt, Artificial Sequence
  derived and/or modified sequence opt2 from VP1__Norovirus__AFJ21407
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggguccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccaccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13792 - RNA, 1623 nt, Artificial Sequence
  derived and/or modified sequence opt2 from VP1__Norovirus__AFJ21409
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13793 - RNA, 1623 nt, Artificial Sequence
  derived and/or modified sequence opt2 from VP1__Norovirus__AFJ21410
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13794 - RNA, 1623 nt, Artificial Sequence; identical to SEQ ID NO: 13793
  derived and/or modified sequence opt2 from VP1__Norovirus__AFJ21411

SEQ ID NO: 13795 - RNA, 1623 nt, Artificial Sequence; identical to SEQ ID NO: 13793
  derived and/or modified sequence opt2 from VP1__Norovirus__AFJ21413

SEQ ID NO: 13796 - RNA, 1623 nt, Artificial Sequence; identical to SEQ ID NO: 13292
  derived and/or modified sequence opt2 from VP1__Norovirus__AFJ21414

SEQ ID NO: 13797 - RNA, 1623 nt, Artificial Sequence; identical to SEQ ID NO: 13793
  derived and/or modified sequence opt2 from VP1__Norovirus__AFJ21415

SEQ ID NO: 13798 - RNA, 1623 nt, Artificial Sequence; identical to SEQ ID NO: 13292
  derived and/or modified sequence opt2 from VP1__Norovirus__AFJ21416

SEQ ID NO: 13799 - RNA, 1623 nt, Artificial Sequence; identical to SEQ ID NO: 13793
  derived and/or modified sequence opt2 from VP1__Norovirus__AFJ21417

SEQ ID NO: 13800 - RNA, 1623 nt, Artificial Sequence
  derived and/or modified sequence opt2 from VP1__Norovirus__AFJ21418
augaagauggccuccuccgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcauccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccacccuccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13801 - RNA, 1623 nt, Artificial Sequence
  derived and/or modified sequence opt2 from VP1__Norovirus__AFJ21419
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccucaucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13802 - RNA, 1623 nt, Artificial Sequence; identical to SEQ ID NO: 13793
  derived and/or modified sequence opt2 from VP1__Norovirus__AFJ21420

SEQ ID NO: 13803 - RNA, 1623 nt, Artificial Sequence
  derived and/or modified sequence opt2 from VP1__Norovirus__AFJ21421
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgucgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaucggccagcacgaccucgucaucccccccaacggcuacuuccgcuucgacuccugggucaaccaguucuacacccucgcccccaugggcaacggcaccggccgccgccgcgcccucuga

SEQ ID NO: 13804 - RNA, 1623 nt, Artificial Sequence; identical to SEQ ID NO: 13793
  derived and/or modified sequence opt2 from VP1__Norovirus__AFJ21422

SEQ ID NO: 13805 - RNA, 1623 nt, Artificial Sequence; identical to SEQ ID NO: 13288
  derived and/or modified sequence opt2 from VP1__Norovirus__AFJ21423

SEQ ID NO: 13806 - RNA, 1623 nt, Artificial Sequence; identical to SEQ ID NO: 13292
  derived and/or modified sequence opt2 from VP1__Norovirus__AFJ21424

SEQ ID NO: 13807 - RNA, 1623 nt, Artificial Sequence
  derived and/or modified sequence opt2 from VP1__Norovirus__AFJ21425
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacaacuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13808 - RNA, 1623 nt, Artificial Sequence; identical to SEQ ID NO: 13292
  derived and/or modified sequence opt2 from VP1__Norovirus__AFJ21426

SEQ ID NO: 13809 - RNA, 1623 nt, Artificial Sequence
  derived and/or modified sequence opt2 from VP1__Norovirus__AFJ21428
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccgccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13810 - RNA, 1623 nt, Artificial Sequence; identical to SEQ ID NO: 13292
  derived and/or modified sequence opt2 from VP1__Norovirus__AFJ21429

SEQ ID NO: 13811 - RNA, 1623 nt, Artificial Sequence; identical to SEQ ID NO: 13292
  derived and/or modified sequence opt2 from VP1__Norovirus__AFJ21430

SEQ ID NO: 13812 - RNA, 1623 nt, Artificial Sequence; identical to SEQ ID NO: 13292
  derived and/or modified sequence opt2 from VP1__Norovirus__AFJ21431

SEQ ID NO: 13813 - RNA, 1623 nt, Artificial Sequence
  derived and/or modified sequence opt2 from VP1__Norovirus__AFJ21432
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacacccccggcucccacaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13814 - RNA, 1623 nt, Artificial Sequence
  derived and/or modified sequence opt2 from VP1__Norovirus__AFJ21433
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccguccaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13815 - RNA, 1623 nt, Artificial Sequence
  derived and/or modified sequence opt2 from VP1__Norovirus__AFJ21434
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13816 - RNA, 1623 nt, Artificial Sequence; identical to SEQ ID NO: 13292
  derived and/or modified sequence opt2 from VP1__Norovirus__AFJ21436

SEQ ID NO: 13817 - RNA, 1623 nt, Artificial Sequence; identical to SEQ ID NO: 13815
  derived and/or modified sequence opt2 from VP1__Norovirus__AFJ21437

SEQ ID NO: 13818 - RNA, 1623 nt, Artificial Sequence
  derived and/or modified sequence opt2 from VP1__Norovirus__AFJ21438
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaucggccaguacgaccucgucaucccccccaacggcuacuuccgcuucgacuccugggucaaccaguucuacacccucgcccccaugggcaacggcaccggccgccgccgcgcccucuga

SEQ ID NO: 13819 - RNA, 1623 nt, Artificial Sequence; identical to SEQ ID NO: 13288
  derived and/or modified sequence opt2 from VP1__Norovirus__AFJ21439

SEQ ID NO: 13820 - RNA, 1623 nt, Artificial Sequence
  derived and/or modified sequence opt2 from VP1__Norovirus__AFJ21440
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcgccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13821 - RNA, 1623 nt, Artificial Sequence
  derived and/or modified sequence opt2 from VP1__Norovirus__AFJ21441
augaagauggccuccuccgacgccaaccccuccgacggcuccaccgccaaccucguccccgaggucaacaccgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgccgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13822 - RNA, 1623 nt, Artificial Sequence
  derived and/or modified sequence opt2 from VP1__Norovirus__AFJ21442
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaaguccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgacaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgcaagcgcgcccucuga

SEQ ID NO: 13823 - RNA, 1623 nt, Artificial Sequence
  derived and/or modified sequence opt2 from VP1__Norovirus__AFJ21443
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacacccccggcucccacaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13824 - RNA, 1623 nt, Artificial Sequence
  derived and/or modified sequence opt2 from VP1__Norovirus__AFJ21444
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccgccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgaguucucccccaagcucggccgcguccaguucgccaccgacaccgacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13825 - RNA, 1623 nt, Artificial Sequence; identical to SEQ ID NO: 13292
  derived and/or modified sequence opt2 from VP1__Norovirus__AFJ21445

SEQ ID NO: 13826 - RNA, 1623 nt, Artificial Sequence
  derived and/or modified sequence opt2 from VP1__Norovirus__AFJ21446
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccgucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13827 - RNA, 1623 nt, Artificial Sequence; identical to SEQ ID NO: 13292
  derived and/or modified sequence opt2 from VP1__Norovirus__AFJ21448

SEQ ID NO: 13828 - RNA, 1623 nt, Artificial Sequence
  derived and/or modified sequence opt2 from VP1__Norovirus__AFJ21451
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagacccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccacccagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcuccaccacccaccgcaacgagccccagcagugggcccuccccuccuacuccggccgcuccgcccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13829 - RNA, 1623 nt, Artificial Sequence
  derived and/or modified sequence opt2 from VP1__Norovirus__AFJ21454
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccuccucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13830 - RNA, 1623 nt, Artificial Sequence
  derived and/or modified sequence opt2 from VP1__Norovirus__AFL70023
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucgcccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacgucggcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcgcccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13831 - RNA, 1653 nt, Artificial Sequence
  derived and/or modified sequence opt2 from VP1__Norovirus__AFN06724
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggaguccaccccccgcaugcgccucaucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcgaccacccccuccacguccaggucaagaaccucgacggcacccaguacgaccccaccgacgacauccccgccguccucggcgccaucgacuucaagggcaccgucuucggcgucgccucccagcgcgacgucuccggccagcaggagcagggccacuacgccacccgcgcccacgaggcccacaucgacaccaccgaccccaaguacgcccccaagcucggcaccauccucaucaaguccgaguccaacgacuucaccaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuucggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 13832 - RNA, 1653 nt, Artificial Sequence
  derived and/or modified sequence opt2 from VP1__Norovirus__AFN06725
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucaucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcgaccacccccuccacguccaggucaagaaccucgacggcacccaguacgaccccaccgacgacauccccgccguccucggcgccaucgacuucaagggcaccgucuucggcgucgccucccagcgcgacgucuccggccagcaggagcagggccacuacgccacccgcgcccacgaggcccacaucgacaccaccgaccccaaguacgcccccaagcucggcaccauccucaucaaguccgaguccaacgacuucaccaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuucggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 13833 - RNA, 1629 nt, Artificial Sequence
  derived and/or modified sequence opt2 from VP1__Norovirus__AFN06726
augaagauggccuccaacgacgccgcccccuccaccgacggcgccgccggccucguccccgaguccaacuccgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccaggacaacgaccaccucuacaacaucaccaucaccaaccucaacggcucccccuucgaccccuccgaggacauccccgccccccucggcguccccgacuuccagggccgcgucuucggcgucaucacccagcgcgacaagcagaacgccgccggccagucccagcccgccaaccgcggccacgacgccgucguccccaccuacaccgcccaguacacccccaagcucggccagguccagaucggcaccuggcagaccgacgaccucaaggucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuaccucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 13834 - RNA, 1617 nt, Artificial Sequence
  derived and/or modified sequence opt2 from VP1__Norovirus__AFN06727
augaagauggccuccaacgacgccacccccuccgacgacggcgccgccggccucguccccgagaucaacaacgaggucauggcccucgagcccgucgccggcgccuccaucgccgcccccgucgucggccagcagaacaucaucgaccccuggauccgcaacaacuucguccaggcccccgccggcgaguucaccgucuccccccgcaacucccccggcgagcuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgccaucccccccuccuuccccuacgagaaccucucccccgcccagcucaccaugugcccccacgucaucgucgacguccgccagcucgagcccguccuccuccccaugcccgacauccgcaacgucuucuaccacuacaaccagaacaacucccccaagcuccgccucgucgccaugcucuacaccccccuccgcgccaacaacuccggcgacgacgucuucaccgucuccugccgcguccucacccgccccucccccgacuuccaguucaccuuccucgucccccccaccgucgaguccaagaccaagaacuucacccuccccguccuccgcgucuccgagaugaccaacucccgcuuccccgucguccucgaccagauguacaccucccgcaacgagaacaucaucguccagccccagaacggccgcugcaccaccgacggcgagcuccucggcaccaccauccuccaguccgucuccaucugcaacuucaagggcaccaugcaggccgagcucuccgaccagccccgcuaccaguaccagcuccagcucaccaaccucgacggcucccccaucgaccccaccgacgacguccccgccccccucggcacccccgacuuccaggccaugcucuacggcgucgccucccagcgcuccucccgcgacaacgccacccgcgcccacgacgcccagaucgacaccgccggcgacaccuucgcccccaagaucggccagguccgcuucaaguccuccuccaacgacuucgaccuccacgaccccaccaaguucacccccaucggcgucaacgucgacgaccagcaccccuuccgccaguggucccuccccaacuacggcggccaccucgcccucaacaaccaccucgcccccgccgucaccccccucuuccccggcgagcagauccucuucuuccgcuccuacauccccuccgccggcggccacaccgacggcgccauggacugccuccucccccaggaguggaucgagcacuucuaccaggaguccgcccccucccaguccgacaucgcccucguccgcuucaucaaccccgacaccggccgcguccucuucgaggccaagcuccacaagcagggcuuccucaccaucgccgccuccggcgaccaccccaucgucaugcccaccaacggcuacuuccgcuucgaggccugggucaaccccuucuacacccucgcccccgucggcaccggcuccggccgccgccgcauccaguga

SEQ ID NO: 13835 - RNA, 1647 nt, Artificial Sequence
  derived and/or modified sequence opt2 from VP1__Norovirus__AFN06728
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacaccgccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccgacgacuucgaccccaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 13836 - RNA, 1647 nt, Artificial Sequence
  derived and/or modified sequence opt2 from VP1__Norovirus__AFN06729
augaagauggccuccaacgacgccgcccccuccaacgacggcgccgccggccucguccccgagaucaacaacgaggccauggcccucgagcccgucgucggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaucaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacaccgccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucacccccaagcucggcucccucgagaucuccaccgaguccggcgacuucgaccccaaccagcccacccgcuucacccccgucggcaucggcgucgacaacgaggccgacuuccagcaguggucccuccccgacuacuccggccaguucacccacaacaugcaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 13837 - RNA, 1644 nt, Artificial Sequence
  derived and/or modified sequence opt2 from VP1__Norovirus__AFN06730
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagaccaucgucguccagccccagaacggccgcugcacccucgacggcacccuccagggcaccacccagcucguccccacccagaucugcuccuuccgcggcacccucaucucccagaccucccgcuccgccgaguccaccgacuccgccccccgcguccgcaaccacccccuccacguccagcucaagaaccucgacggcacccccuacgaccccaccgacgagguccccgccguccucggcgccaucgacuucaagggcaccgucuucggcgucgccucccagcgcaacaccaccggcuccuccgccggcgccacccgcgcccacgagguccacaucgacaccaccaacccccgcuacacccccaagcucggcuccguccucauguacuccgaguccaccgacuucgacgacggccagcccacccgcuucacccccaucggcaugggcgccgacgacuggcgccagugggagcuccccgaguacuccggccaccucacccucaacaugaaccucgcccccgccgucgcccccgccuuccccggcgagcgcauccucuucuuccgcuccgucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcguccaguga

SEQ ID NO: 13838 - RNA, 1623 nt, Artificial Sequence
  derived and/or modified sequence opt2 from VP1__Norovirus__AFN06731
augaagauggccuccaacgacgccgcccccuccuccgacggcgccgccggccucguccccgagaucaacaacgaggucaugccccucgagcccgucgccggcgccucccucgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuuccccuacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucgucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgacgucauguacaccgcccgcaacgagaaccaggucguccagccccagaacggccgcgucacccucgacggcgagcuccucggcaccaccccccuccucgccgucaacaucugcaaguucaagggcgaggucaucgccaagaacggcgacguccgcuccuaccgcauggacauggagaucaccaacaccgacggcacccccaucgaccccaccgaggacacccccggccccaucggcucccccgacuuccagggcauccucuucggcgucgccucccagcgcaacaagaacgagcagaaccccgccacccgcgcccacgaggccaacaucaacaccggcggcgaccaguacgcccccaagcucgcccaggucaaguucuucuccgagucccaggacuucgagguccaccagcccaccaucuucacccccgucggcgucgccggcgacaccucccaccccuuccgccaguggacccucccccgcuacggcggccaccucaccaacaacacccaccucgcccccgccgucgccccccucuuccccggcgagcagcuccucuucuuccgcucccagauccccuccuccggcggccacgagcagggcuacauggacugccucgucccccaggaguggguccagcacuucuaccaggaggccgccaccgcccaguccgaggucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcguccaguga

SEQ ID NO: 13839 - RNA, 1623 nt, Artificial Sequence
  derived and/or modified sequence opt2 from VP1__Norovirus__AFN06732
augaagauggccuccaacgacgccgcccccuccaacgacggcgccaccggccucguccccgagaucaaccacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccgccaaccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucaccaucuccgagcucaccaacucccgcuuccccgcccccaucgacucccucuacaccgcccagaacaacaaccucaacguccagugccagaacggccgcugcacccucgacggcgagcuccagggcaccacccagcuccuccccuccggcaucugcgccuuccgcggcaagcucaccgccgacguccaccagucccacgacgaccgcuggcacaugcagcucaccaaccucaacggcacccccuucgaccccaccgaggacguccccgccccccucggcacccccgacuucaccggccuccucuucggcgucgccucccagcgcaacgucgucuccaaccccaacaccacccgcgcccacgaggccgucaucuccaccaccuccucccaguucguccccaagcucggcuccaucaacuucggcuccaccuccgacgacuuccagcuccagcagcccaccaaguucacccccgucggcaucaaggucgaguccggccacgacuucgaccagugggcccucccccgcuacuccggccaccucacccucaacaugaaccucgccccccccgucgcccccaacuuccccggcgagcagcuccucuucuuccgcuccaacguccccugcgccggcggcgucuccgacggcgucaucgacugccuccucccccaggaguggauccagcacuucuaccaggaguccgcccccucccaguccgacgucgcccucauccgcuacgucaaccccgacaccggccgcacccucuucgaggccaagcuccaccgcaccggcuacaucaccgucgcccacuccggcgacuacccccucgucguccccuccaacggcuacuuccgcuucgacuccugggucaaccaguucuacucccucgcccccaugggcaccggcaacggccgccgccgcguccaguga

SEQ ID NO: 13840 - RNA, 1623 nt, Artificial Sequence
  derived and/or modified sequence opt2 from VP1__Norovirus__AFN06733
augaagauggccuccaacgacgccgcccccuccaacgacggcgccgccggccucguccccgaguccuccaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagguccucgucaaccucgagcucggccccgagcucaaccccuaccucgcccaccucgccaugauguacaacggcuacgccggcggcauggagguccagguccuccucgccggcaacgccuucaccgccggcaagaucaucuucgccgccgucccccccuacuuccccgucgagaaccucucccccucccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagcuccaggccugcaacaucugcuccauccgcggcaaggucaccggccagguccccaacgagcagcacauguggaaccucgagaucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuccugggucaaccaguucuacucccucgcccccaugggcaccggcaacggccgccgccgcuuccaguga

SEQ ID NO: 13841 - RNA, 1623 nt, Artificial Sequence
  derived and/or modified sequence opt2 from VP1__Norovirus__AFN06734
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuuccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacgucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacuccggcgacaucaucggcucccucggcuggaucuccgcccccuccgacuccucccagcucaacgucuggaccauccccaaguacggcuccucccuccccgacgucacccaccucgcccccgccgucuucccccccggcuucggcgaggucauccucuacuuccacuccaccuuccccggcuccggccagcccggccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 13842 - RNA, 1632 nt, Artificial Sequence
  derived and/or modified sequence opt2 from VP1__Norovirus__AFN06735
augaugauggccuccaaggacgccucccccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucaucugcugcgucccccccggcuuccagucccgcacccucuccaucgcccaggccacccucuucccccacaucaucgccgacguccgcacccucgagcccaucgagaucccccucgaggacguccgcaacacccucuaccacaccaacgacaaccagcccaccaugcgccuccucugcaugcucuacaccccccuccgcaccggcggcggcuccggcggcaccgacgccuucgucgucgccggccgcguccucaccugccccuccuccgacuucaacuuccucuuccucgucccccccaccgucgagcagaagacccgccccuucuccguccccaacaucccccuccagcuccucuccaacucccgcguccccaaccucauccaguccaugguccucucccccgaccaggcccagaacguccaguuccagaacggccgcugcaccaccgacggccagcuccucggcaccacccccgucuccgucucccagauccucaaguuccgcggcaaggucuccgccggcucccgcgucaucaaccucaccgagcucgacggcucccccuuccucgccuucgaggcccccgcccccaccggcuuccccgaccucggcaccuccgacuggcacgucgagaugucccucaacuccaacucccaguccuccggcaaccccauccuccuccgcgacauccagcccaacuccuccgacuucgucccccaccucggcuccgucuccgucaccaccgccaucgacgucgccggcgacuacaccggcaccauccaguggaccucccagcccuccaacgucacccccguccccgacgucaacuucuggaccaucccccaguacggcuccaaccucgccgaggccucccagcucgcccccgucgucuacccccccggcuucggcgaggccaucgucuacuucaugucccccauccccggccccaacaccgcccacaagcccaaccucguccccugccuccucccccaggaguucgucacccacuucgucuccgagcaggcccccuccaugggcgaggccgcccucguccacuacgucgaccccgacaccaaccgcaaccucggcgaguucaagcucuaccccgagggcuucaucaccugcguccccaacggcaccggcccccagcagcucccccucaacggcgucuucgucuucgccuccugggucucccgcuucuaccagcucaagcccgucggcaccgccuccuccgcccgcggccgccucggcguccgccgcuga

SEQ ID NO: 13843 - RNA, 1635 nt, Artificial Sequence
  derived and/or modified sequence opt2 from VP1__Norovirus__AFN06736
augaugauggccuccaaggacgcccccaccaacauggacggcaccuccggcgccggccagcucguccccgaggccaacaccgccgagcccaucuccauggaccccgucgccggcgccgccaccgccgucgccaccgccggccagaucaacaugaucgaccccuggaucauguccaacuucguccaggccccccagggcgaguucaccgucucccccaacaacacccccggcgacguccucuucgaccuccagcucggcccccagcucaaccccuuccucgcccaccucgcccagauguacaacggcugggucggcaacaugcgcgucaagguccuccucgccggcaacgccuucaccgccggcaagaucaucaucuccugcaucccccccggcuucaccucccagaacaucuccaucgcccagaugaccauguucccccacgucaucgccgacguccgcguccucgagcccaucgagaucccccucgaggacguccgcaacguccucuuccacaccaacgacaaccgccccaccaugcgccucgucugcaugcucuacaccccccuccgcgccaacggcuccuccuccggcaccgaccccuucgucaucgccggccgcguccucaccugccccgacuccaacuucuccuuccucuuccucgucccccccaacgucgagcagaagacccgccccuucuccguccccaacaucccccucaacacccucuccaacucccgcguccccucccucaucaaguccaugaccaucucccgcgaccagaaccagaucauccaguuccagaacggccgcgucacccucgacggccagcuccagggcaccacccccaccuccgucucccagcucugcaagauccgcggcaccaccuaccacgccaccggcggcaacggcaucaaccucaccgagcucaacggcgagcccuaccacgccuucgagucccccgcccccaucggcuuccccgaccucggcggcugcgacuggcaccucaccgccacccccacccaggccuucaacgacggcgccaaggucguccgccucuccgucacccagggcgccgccuucgccccccaccucggcaccauccacuacaccaccaccgaccacgacuacgaccccaacaccuccaucaucugcacccucgacuggcucucccagaccaccggccagaacaacgucgaccccuggcagauccccaccuacggcuccacccucaccgaggccgcccagcucgccccccccaucuucccccccggcuucggcgagacccucgucuucuuccucuccgacuuccccaucuccaacggcaagaacggccucuccguccccugcacccucccccaggaguucgucacccacuucgucaacgagcaggcccccauccgcggcgaggccgcccuccuccacuacgucgaccccgacacccaccgcaaccucggcgaguucaagcucuaccccgagggcuucaugaccugcguccccaacaccuccggcggcggcccccagacccuccccaucaacggcgucuucgucuucgucuccugggucucccgcuucuaccagcucaagcccgucggcaccgccggcgccgcccgccgccucggcauccgccgcuccuga

SEQ ID NO: 13844 - RNA, 1635 nt, Artificial Sequence
  derived and/or modified sequence opt2 from VP1__Norovirus__AFN06738
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccucccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacguccucuccaacucccgcguccccucccucaucaaguucaugauggucucccaggaccacggccagaugguccaguuccagaacggccgcgucacccucgacggccagcuccagggcaccacccccaccuccgccucccagcucugcaagaugcgcggcaccgucuaccacgccuccggcggccagggccucaaccucaccgagaucgacggcacccccuaccacgccuucgagucccccgcccccaucggcuuccccgaccucggcgacuccgacuggcacaucaacgccucccccgccaccaccuucaacaccggcgaguccgucaagcgccucgacauggagcagggcuccuccuucgccccccaccucggcaccguccacuacaccaacgccgacuacgacgccaacaccgaccucaucugcucccucgaguggcucuccccccccuccggcggcacccccaacaaggucaaccccugggccaucccccgcuacggcuccacccucaccgaggccgcccagcucgccccccccaucuacccccccggcuucggcgaggccaucgucuucuucauguccgacuuccccaucgccaacggccaggacggccucaagguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucgucuccugggucucccgcuucuaccagcucaagcccgucggcaccaccggccccguccgccgccucggcauccgccgcuccuga

SEQ ID NO: 13845 - RNA, 1635 nt, Artificial Sequence
  derived and/or modified sequence opt2 from VP1__Norovirus__AFN06739
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccucccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacguccucuccaacucccgcguccccucccucaucaaguccaugauggucucccaggaccacggccagaugguccaguuccagaacggccgcgucacccucgacggccagcuccagggcaccacccccaccuccgccucccagcucugcaagaugcgcggcaccgucuaccacgccuccggcggccagggccucaaccucaccgagaucgacggcacccccuaccacgccuucgagucccccgcccccaucggcuuccccgacaucggcgacuccgacuggcacaucaacgccucccccgccaccaccuucgacuccggcgaguccaucaagcgccucgacauggagcagggcuccuccuucgccccccaccucggcaccguccacuacaccaacgccgacuaccccgccaacaccgaccucaucugcucccucgaguggcucuccccccccuccggcggcacccccaacaaggucaaccccuggaccaucccccgcuacggcuccacccucaccgaggccgcccagcucgccccccccaucuacccccccggcuucggcgaggccaucgucuucuucauguccgacuuccccaucgccaacggccaggacggccucaagguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucgucuccugggucucccgcuucuaccagcucaagcccgucggcaccaccggccccguccgccgccucggcauccgccgcuccuga

SEQ ID NO: 13846 - RNA, 1623 nt, Artificial Sequence
  derived and/or modified sequence opt2 from VP1__Norovirus__AFV08771
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13847 - RNA, 1623 nt, Artificial Sequence; identical to SEQ ID NO: 13444
  derived and/or modified sequence opt2 from VP1__Norovirus__AFV08774

SEQ ID NO: 13848 - RNA, 1623 nt, Artificial Sequence
  derived and/or modified sequence opt2 from VP1__Norovirus__AFV08777
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccuccuuccccaucgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcaacgucacccacaucuccggcucccgcaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13849 - RNA, 1623 nt, Artificial Sequence
  derived and/or modified sequence opt2 from VP1__Norovirus__AFV08780
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgaccacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccaccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13850 - RNA, 1623 nt, Artificial Sequence
  derived and/or modified sequence opt2 from VP1__Norovirus__AFV08783
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13851 - RNA, 1623 nt, Artificial Sequence
  derived and/or modified sequence opt2 from VP1__Norovirus__AFV08786
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13852 - RNA, 1623 nt, Artificial Sequence
  derived and/or modified sequence opt2 from VP1__Norovirus__AFV08789
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13853 - RNA, 1623 nt, Artificial Sequence
  derived and/or modified sequence opt2 from VP1__Norovirus__AFV08792
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgacgagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13854 - RNA, 1623 nt, Artificial Sequence
  derived and/or modified sequence opt2 from VP1__Norovirus__AFV08795
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacgacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13855 - RNA, 1623 nt, Artificial Sequence
  derived and/or modified sequence opt2 from VP1__Norovirus__AFX95940
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13856 - RNA, 1620 nt, Artificial Sequence
  derived and/or modified sequence opt2 from VP1__Norovirus__AFZ84663
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcguccucuga

SEQ ID NO: 13857 - RNA, 1623 nt, Artificial Sequence
  derived and/or modified sequence opt2 from VP1__Norovirus__AGG37871
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgaggucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcgccgucuga

SEQ ID NO: 13858 - RNA, 1623 nt, Artificial Sequence
  derived and/or modified sequence opt2 from VP1__Norovirus__AGI96383
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucuccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13859 - RNA, 1623 nt, Artificial Sequence
  derived and/or modified sequence opt2 from VP1__Norovirus__AGI99552
augaagauggccuccuccgacgccaaccccuccgacggcuccgccgccaaccucguccccaaggucaacaacgaggucauggcccucgagcccgucgucggcgccgccaucgccgcccccgucgccggccagcagaacgucaucgaccccuggaucaagaacaacuucguccaggcccccggcggcgaguucaccgucucccccaagaacgcccccggcgagauccucugguccgccccccucggccccgaccucaaccccuaccucucccaccucgccaagauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaucggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcccccucuga

SEQ ID NO: 13860 - RNA, 1623 nt, Artificial Sequence
  derived and/or modified sequence opt2 from VP1__Norovirus__AGI99553
augaagauggccuccuccgacgccaacccccccgacggcuccgccgccaaccucguccccaaggucaacaacgaggucauggcccucgagcccgucgucggcgccgccaucgccgcccccgucgccggccagcagaacgucaucgaccccuggaucaagaacaacuucguccaggcccccggcggcgaguucaccgucucccccaagaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcgacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcccccucuga

SEQ ID NO: 13861 - RNA, 1623 nt, Artificial Sequence
  derived and/or modified sequence opt2 from VP1__Norovirus__AGI99554
augaagauggccuccuccgacgccaaccccuccgacggcuccgccgccaaccucguccccaaggucaacaacgaggucauggcccucgagcccgucgucggcgccgccaucgccgcccccgucgccggccagcagaacgucaucgaccccuggaucaagaacaacuucguccaggcccccggcggcgaguucaccgucucccccaagaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcccccucuga

SEQ ID NO: 13862 - RNA, 1623 nt, Artificial Sequence
  derived and/or modified sequence opt2 from VP1__Norovirus__AGI99555
augaagauggccuccuccgacgccaaccccuccgacggcuccgccgccaaccucguccccaaggucaacaacgaggucauggcccucgagcccgucgucggcgccgccaucgccgcccccgucgccggccagcagaacgucaucgaccccuggaucaagaacaacuucguccaggcccccggcggcgaguucaccgucucccccaagaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcccccucuga

SEQ ID NO: 13863 - RNA, 1623 nt, Artificial Sequence
  derived and/or modified sequence opt2 from VP1__Norovirus__AGK25882
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccgccucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccuacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaucaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucaucaucccccccaacggcuacuuccgcuucgacuccugggucaaccaguucuacacccucgcccccaugggcaacggcaccggccgccgccgcgcccucuga

SEQ ID NO: 13864 - RNA, 1623 nt, Artificial Sequence
  derived and/or modified sequence opt2 from VP1__Norovirus__AGK25884
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccgccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcugccccgacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucaucaucccccccaacggcuacuuccgcuucgacuccugggucaaccaguucuacacccucgcccccaugggcaacggcaccggccgccgccgcgcccucuga

SEQ ID NO: 13865 - RNA, 1623 nt, Artificial Sequence
  derived and/or modified sequence opt2 from VP1__Norovirus__AGK25887
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccguccacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13866 - RNA, 1623 nt, Artificial Sequence
  derived and/or modified sequence opt2 from VP1__Norovirus__AGK25890
augaagauggccuccuccgacgccaaccccuccgacggcuccgccgccaaccucguccccgaggucaacaacgaggucaucgcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucgcccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaaccuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13867 - RNA, 1623 nt, Artificial Sequence; identical to SEQ ID NO: 13252
  derived and/or modified sequence opt2 from VP1__Norovirus__AGK25892

SEQ ID NO: 13868 - RNA, 1623 nt, Artificial Sequence
  derived and/or modified sequence opt2 from VP1__Norovirus__AGK25898
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucgacaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacgcccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgccgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13869 - RNA, 1623 nt, Artificial Sequence
  derived and/or modified sequence opt2 from VP1__Norovirus__AGK25900
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaacuccgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13870 - RNA, 1623 nt, Artificial Sequence
  derived and/or modified sequence opt2 from VP1__Norovirus__AGK25902
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgccuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccgcccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13871 - RNA, 1623 nt, Artificial Sequence
  derived and/or modified sequence opt2 from VP1__Norovirus__AGK25905
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucgcccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccgagaacgccuucaccgccggcaagaucaucuucgccgccgucccccccaacuuccccaccgagggccucucccccucccgcgucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaccaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacguccccaccgaggagauccccgccccccucggcacccccgacuucgucggcaagguccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13872 - RNA, 1623 nt, Artificial Sequence
  derived and/or modified sequence opt2 from VP1__Norovirus__AGK25908
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccaccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13873 - RNA, 1623 nt, Artificial Sequence
  derived and/or modified sequence opt2 from VP1__Norovirus__AGK25910
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccguccccuccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacacccuccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccauguacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgccccaccaugcccggcugcuccggcuaccccaacauggaccucgaccgccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13874 - RNA, 1623 nt, Artificial Sequence
  derived and/or modified sequence opt2 from VP1__Norovirus__AGK25912
augaagauggccuccaacgacgccaaccccuccgacggcuccgccgccaaccucguccccgaggucgacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgccccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13875 - RNA, 1623 nt, Artificial Sequence
  derived and/or modified sequence opt2 from VP1__Norovirus__AGK25915
augaagauggccuccaacgacgccaaccccuccgacggcuccgccgucaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacgcccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucgcccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccuccucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccuccggcuacuuccgcuucgacuccugggucaaccaguucuacacccucgcccccaugggcaacggcaccggccgccgccgcgcccucuga

SEQ ID NO: 13876 - RNA, 1623 nt, Artificial Sequence
  derived and/or modified sequence opt2 from VP1__Norovirus__AGK25917
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacuccggcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagguccagggcguccucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccgcccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcgcgaccucgucaucccccccaacggcuacuuccgcuucgacuccugggucaaccaguucuacacccucgcccccaugggcaacggcaccggccgccgccgcgcccucuga

SEQ ID NO: 13877 - RNA, 1623 nt, Artificial Sequence
  derived and/or modified sequence opt2 from VP1__Norovirus__AGK25919
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccacuccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcuccggcaccggccgccgccgcgccgucuga

SEQ ID NO: 13878 - RNA, 1623 nt, Artificial Sequence
  derived and/or modified sequence opt2 from VP1__Norovirus__AGK25921
augaagauggccuccuccgacgccaaccccuccgacggcuccgccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacgccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13879 - RNA, 1623 nt, Artificial Sequence
  derived and/or modified sequence opt2 from VP1__Norovirus__AGK25924
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuccaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13880 - RNA, 1623 nt, Artificial Sequence
  derived and/or modified sequence opt2 from VP1__Norovirus__AGK25927
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacgccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccaacaccggccgcguccucuucgagugcaagcuccacaaguccggcuacgucaccgucgcccacaccggccagcacgaccucgucaucccccccaacgacuacuuccgcuucgacuccugggucaaccaguucuacacccucgcccccaugggcaacggcaccggccgccgccgcgccgucuga

SEQ ID NO: 13881 - RNA, 1623 nt, Artificial Sequence
  derived and/or modified sequence opt2 from VP1__Norovirus__AGK25930
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacgucggcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13882 - RNA, 1623 nt, Artificial Sequence
  derived and/or modified sequence opt2 from VP1__Norovirus__AGS08025
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13883 - RNA, 1623 nt, Artificial Sequence; identical to SEQ ID NO: 13444
  derived and/or modified sequence opt2 from VP1__Norovirus__AGS08026

SEQ ID NO: 13884 - RNA, 1623 nt, Artificial Sequence
  derived and/or modified sequence opt2 from VP1__Norovirus__AGS08027
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccgccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcaacaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13885 - RNA, 1623 nt, Artificial Sequence
  derived and/or modified sequence opt2 from VP1__Norovirus__AGS08028
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggagaccgcccccgcccaguccgacgucgcccuccuccgcuucgucaaccccgacaccggccgcguccucuucgagugcaagcuccacaaguccugcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13886 - RNA, 1623 nt, Artificial Sequence; identical to SEQ ID NO: 13292
  derived and/or modified sequence opt2 from VP1__Norovirus__AGS08029

SEQ ID NO: 13887 - RNA, 1623 nt, Artificial Sequence; identical to SEQ ID NO: 13292
  derived and/or modified sequence opt2 from VP1__Norovirus__AGS08030

SEQ ID NO: 13888 - RNA, 1623 nt, Artificial Sequence; identical to SEQ ID NO: 13292
  derived and/or modified sequence opt2 from VP1__Norovirus__AGS08031

SEQ ID NO: 13889 - RNA, 1623 nt, Artificial Sequence; identical to SEQ ID NO: 13252
  derived and/or modified sequence opt2 from VP1__Norovirus__AGS08032

SEQ ID NO: 13890 - RNA, 1623 nt, Artificial Sequence
  derived and/or modified sequence opt2 from VP1__Norovirus__AGS08033
augaagauggccuccuccgacgccaaccccuccgacggcuccgucgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13891 - RNA, 1623 nt, Artificial Sequence
  derived and/or modified sequence opt2 from VP1__Norovirus__AGS08035
augaagauggccuccuccgacgccaaccccuccgacggcuccaccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcguccucacccagaccacccgcaucaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13892 - RNA, 1623 nt, Artificial Sequence; identical to SEQ ID NO: 13444
  derived and/or modified sequence opt2 from VP1__Norovirus__AGS08036

SEQ ID NO: 13893 - RNA, 1623 nt, Artificial Sequence; identical to SEQ ID NO: 13292
  derived and/or modified sequence opt2 from VP1__Norovirus__AGS08037

SEQ ID NO: 13894 - RNA, 1623 nt, Artificial Sequence
  derived and/or modified sequence opt2 from VP1__Norovirus__AGS08038
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13895 - RNA, 1623 nt, Artificial Sequence; identical to SEQ ID NO: 13292
  derived and/or modified sequence opt2 from VP1__Norovirus__AGS08040

SEQ ID NO: 13896 - RNA, 1623 nt, Artificial Sequence; identical to SEQ ID NO: 13444
  derived and/or modified sequence opt2 from VP1__Norovirus__AGS08041

SEQ ID NO: 13897 - RNA, 1623 nt, Artificial Sequence; identical to SEQ ID NO: 13252
  derived and/or modified sequence opt2 from VP1__Norovirus__AGS08042

SEQ ID NO: 13898 - RNA, 1623 nt, Artificial Sequence
  derived and/or modified sequence opt2 from VP1__Norovirus__AGS08043
augaagauggccuccuccgacgccaaccccuccgacggcuccaccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacuccgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacaucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13899 - RNA, 1623 nt, Artificial Sequence
  derived and/or modified sequence opt2 from VP1__Norovirus__AGS08044
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13900 - RNA, 1623 nt, Artificial Sequence
  derived and/or modified sequence opt2 from VP1__Norovirus__AGS08045
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccgucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13901 - RNA, 1623 nt, Artificial Sequence
  derived and/or modified sequence opt2 from VP1__Norovirus__AGS08047
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13902 - RNA, 1623 nt, Artificial Sequence; identical to SEQ ID NO: 13444
  derived and/or modified sequence opt2 from VP1__Norovirus__AGS08048

SEQ ID NO: 13903 - RNA, 1623 nt, Artificial Sequence
  derived and/or modified sequence opt2 from VP1__Norovirus__AGS08050
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13904 - RNA, 1623 nt, Artificial Sequence
  derived and/or modified sequence opt2 from VP1__Norovirus__AGS08051
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcgccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13905 - RNA, 1623 nt, Artificial Sequence
  derived and/or modified sequence opt2 from VP1__Norovirus__AGS08052
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucggcaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13906 - RNA, 1623 nt, Artificial Sequence
  derived and/or modified sequence opt2 from VP1__Norovirus__AGS08054
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucgccgaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13907 - RNA, 1623 nt, Artificial Sequence
  derived and/or modified sequence opt2 from VP1__Norovirus__AGS08056
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13908 - RNA, 1623 nt, Artificial Sequence
  derived and/or modified sequence opt2 from VP1__Norovirus__AGS08057
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccgacaacgacuucgucgccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13909 - RNA, 1623 nt, Artificial Sequence
  derived and/or modified sequence opt2 from VP1__Norovirus__AGS08058
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13910 - RNA, 1623 nt, Artificial Sequence
  derived and/or modified sequence opt2 from VP1__Norovirus__AGS08059
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggaacgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgccaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13911 - RNA, 1623 nt, Artificial Sequence
  derived and/or modified sequence opt2 from VP1__Norovirus__AGS08060
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13912 - RNA, 1623 nt, Artificial Sequence; identical to SEQ ID NO: 13252
  derived and/or modified sequence opt2 from VP1__Norovirus__AGS08061

SEQ ID NO: 13913 - RNA, 1623 nt, Artificial Sequence; identical to SEQ ID NO: 13907
  derived and/or modified sequence opt2 from VP1__Norovirus__AGS08062

SEQ ID NO: 13914 - RNA, 1623 nt, Artificial Sequence; identical to SEQ ID NO: 13899
  derived and/or modified sequence opt2 from VP1__Norovirus__AGS08063

SEQ ID NO: 13915 - RNA, 1623 nt, Artificial Sequence; identical to SEQ ID NO: 13444
  derived and/or modified sequence opt2 from VP1__Norovirus__AGS08064

SEQ ID NO: 13916 - RNA, 1623 nt, Artificial Sequence; identical to SEQ ID NO: 13292
  derived and/or modified sequence opt2 from VP1__Norovirus__AGS08065

SEQ ID NO: 13917 - RNA, 1623 nt, Artificial Sequence; identical to SEQ ID NO: 13899
  derived and/or modified sequence opt2 from VP1__Norovirus__AGS08066

SEQ ID NO: 13918 - RNA, 1623 nt, Artificial Sequence; identical to SEQ ID NO: 13444
  derived and/or modified sequence opt2 from VP1__Norovirus__AGS08067

SEQ ID NO: 13919 - RNA, 1623 nt, Artificial Sequence
  derived and/or modified sequence opt2 from VP1__Norovirus__AGS08068
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13920 - RNA, 1623 nt, Artificial Sequence
  derived and/or modified sequence opt2 from VP1__Norovirus__AGS08069
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13921 - RNA, 1623 nt, Artificial Sequence
  derived and/or modified sequence opt2 from VP1__Norovirus__AGS08070
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucggcguccaggucauccucgccggcaacgccuucaccgccggcaaggucaucuucgccgccgucccccccaacuuccccaccgagggccucucccccucccaggucaccauguucccccacaucgucgucaacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccucaccggccagcacgaccucgucaucccccccaacggcuacuuccgcuucgacuccugggucaaccaguucuacacccucgcccccaugggcaacggcaccggccgccgccgcgccgucuga

SEQ ID NO: 13922 - RNA, 1623 nt, Artificial Sequence; identical to SEQ ID NO: 13907
  derived and/or modified sequence opt2 from VP1__Norovirus__AGS08071

SEQ ID NO: 13923 - RNA, 1623 nt, Artificial Sequence; identical to SEQ ID NO: 13292
  derived and/or modified sequence opt2 from VP1__Norovirus__AGS08072

SEQ ID NO: 13924 - RNA, 1623 nt, Artificial Sequence; identical to SEQ ID NO: 13815
  derived and/or modified sequence opt2 from VP1__Norovirus__AGS08073

SEQ ID NO: 13925 - RNA, 1623 nt, Artificial Sequence; identical to SEQ ID NO: 13899
  derived and/or modified sequence opt2 from VP1__Norovirus__AGS08074

SEQ ID NO: 13926 - RNA, 1623 nt, Artificial Sequence; identical to SEQ ID NO: 13444
  derived and/or modified sequence opt2 from VP1__Norovirus__AGS08076

SEQ ID NO: 13927 - RNA, 1623 nt, Artificial Sequence; identical to SEQ ID NO: 13444
  derived and/or modified sequence opt2 from VP1__Norovirus__AGS08079

SEQ ID NO: 13928 - RNA, 1623 nt, Artificial Sequence; identical to SEQ ID NO: 13899
  derived and/or modified sequence opt2 from VP1__Norovirus__AGS08080

SEQ ID NO: 13929 - RNA, 1623 nt, Artificial Sequence
  derived and/or modified sequence opt2 from VP1__Norovirus__AGS08081
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgucaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13930 - RNA, 1623 nt, Artificial Sequence
  derived and/or modified sequence opt2 from VP1__Norovirus__AGS08082
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucacccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13931 - RNA, 1623 nt, Artificial Sequence; identical to SEQ ID NO: 13444
  derived and/or modified sequence opt2 from VP1__Norovirus__AGS08083

SEQ ID NO: 13932 - RNA, 1623 nt, Artificial Sequence
  derived and/or modified sequence opt2 from VP1__Norovirus__AGS08084
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccaagaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13933 - RNA, 1623 nt, Artificial Sequence
  derived and/or modified sequence opt2 from VP1__Norovirus__AGS08085
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgccaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13934 - RNA, 1623 nt, Artificial Sequence; identical to SEQ ID NO: 13899
  derived and/or modified sequence opt2 from VP1__Norovirus__AGS08086

SEQ ID NO: 13935 - RNA, 1623 nt, Artificial Sequence
  derived and/or modified sequence opt2 from VP1__Norovirus__AGS08087
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccuccaccauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13936 - RNA, 1623 nt, Artificial Sequence; identical to SEQ ID NO: 13899
  derived and/or modified sequence opt2 from VP1__Norovirus__AGS08088

SEQ ID NO: 13937 - RNA, 1623 nt, Artificial Sequence; identical to SEQ ID NO: 13252
  derived and/or modified sequence opt2 from VP1__Norovirus__AGS08089

SEQ ID NO: 13938 - RNA, 1623 nt, Artificial Sequence; identical to SEQ ID NO: 13444
  derived and/or modified sequence opt2 from VP1__Norovirus__AGS08090

SEQ ID NO: 13939 - RNA, 1623 nt, Artificial Sequence
  derived and/or modified sequence opt2 from VP1__Norovirus__AGS08091
augaagauggccuccuccgacgccaaccccaccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagacccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13940 - RNA, 1623 nt, Artificial Sequence; identical to SEQ ID NO: 13444
  derived and/or modified sequence opt2 from VP1__Norovirus__AGS08092

SEQ ID NO: 13941 - RNA, 1623 nt, Artificial Sequence; identical to SEQ ID NO: 13899
  derived and/or modified sequence opt2 from VP1__Norovirus__AGS08093

SEQ ID NO: 13942 - RNA, 1623 nt, Artificial Sequence; identical to SEQ ID NO: 13292
  derived and/or modified sequence opt2 from VP1__Norovirus__AGS08094

SEQ ID NO: 13943 - RNA, 1623 nt, Artificial Sequence; identical to SEQ ID NO: 13292
  derived and/or modified sequence opt2 from VP1__Norovirus__AGS08095

SEQ ID NO: 13944 - RNA, 1623 nt, Artificial Sequence; identical to SEQ ID NO: 13907
  derived and/or modified sequence opt2 from VP1__Norovirus__AGS08096

SEQ ID NO: 13945 - RNA, 1623 nt, Artificial Sequence
  derived and/or modified sequence opt2 from VP1__Norovirus__AGS08097
augaagauggccuccuccgacgccaaccccuccgacggcuccaccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13946 - RNA, 1623 nt, Artificial Sequence
  derived and/or modified sequence opt2 from VP1__Norovirus__AGS08098
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13947 - RNA, 1623 nt, Artificial Sequence; identical to SEQ ID NO: 13444
  derived and/or modified sequence opt2 from VP1__Norovirus__AGS08099

SEQ ID NO: 13948 - RNA, 1623 nt, Artificial Sequence
  derived and/or modified sequence opt2 from VP1__Norovirus__AGS08100
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgucucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13949 - RNA, 1623 nt, Artificial Sequence
  derived and/or modified sequence opt2 from VP1__Norovirus__AGS08101
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucaucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13950 - RNA, 1623 nt, Artificial Sequence; identical to SEQ ID NO: 13855
  derived and/or modified sequence opt2 from VP1__Norovirus__AGS08102

SEQ ID NO: 13951 - RNA, 1623 nt, Artificial Sequence
  derived and/or modified sequence opt2 from VP1__Norovirus__AGS08103
augaagauggccuccuccgacgcccaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13952 - RNA, 1623 nt, Artificial Sequence; identical to SEQ ID NO: 13945
  derived and/or modified sequence opt2 from VP1__Norovirus__AGS08104

SEQ ID NO: 13953 - RNA, 1623 nt, Artificial Sequence; identical to SEQ ID NO: 13911
  derived and/or modified sequence opt2 from VP1__Norovirus__AGS08105

SEQ ID NO: 13954 - RNA, 1623 nt, Artificial Sequence; identical to SEQ ID NO: 13930
  derived and/or modified sequence opt2 from VP1__Norovirus__AGS08106

SEQ ID NO: 13955 - RNA, 1623 nt, Artificial Sequence; identical to SEQ ID NO: 13899
  derived and/or modified sequence opt2 from VP1__Norovirus__AGS08107

SEQ ID NO: 13956 - RNA, 1623 nt, Artificial Sequence
  derived and/or modified sequence opt2 from VP1__Norovirus__AGS08108
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacugguccuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13957 - RNA, 1623 nt, Artificial Sequence
  derived and/or modified sequence opt2 from VP1__Norovirus__AGS08109
augaagauggccuccuccgacgccaaccccuccgacggcuccgccgccaaccucguccccgaggucaacaacgaggucauggcccucgagcccgucgccggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13958 - RNA, 1623 nt, Artificial Sequence
  derived and/or modified sequence opt2 from VP1__Norovirus__AGS08110
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13959 - RNA, 1623 nt, Artificial Sequence
  derived and/or modified sequence opt2 from VP1__Norovirus__AGS08111
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcgcccucuga

SEQ ID NO: 13960 - RNA, 1623 nt, Artificial Sequence; identical to SEQ ID NO: 13444
  derived and/or modified sequence opt2 from VP1__Norovirus__AGS08112

SEQ ID NO: 13961 - RNA, 1623 nt, Artificial Sequence
  derived and/or modified sequence opt2 from VP1__Norovirus__AGS08113
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 13962 - RNA, 1623 nt, Artificial Sequence; identical to SEQ ID NO: 13899
  derived and/or modified sequence opt2 from VP1__Norovirus__AGS08114

SEQ ID NO: 13963 - RNA, 1623 nt, Artificial Sequence; identical to SEQ ID NO: 13444
  derived and/or modified sequence opt2 from VP1__Norovirus__AGS08115

SEQ ID NO: 13964 - RNA, 1623 nt, Artificial Sequence; identical to SEQ ID NO: 13890
  derived and/or modified sequence opt2 from VP1__Norovirus__AGS08116

SEQ ID NO: 13965 - RNA, 1623 nt, Artificial Sequence
  derived and/or modified sequence opt2 from VP1__Norovirus__AGS08117
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13966 - RNA, 1623 nt, Artificial Sequence; identical to SEQ ID NO: 13899
  derived and/or modified sequence opt2 from VP1__Norovirus__AGS08119

SEQ ID NO: 13967 - RNA, 1623 nt, Artificial Sequence; identical to SEQ ID NO: 13945
  derived and/or modified sequence opt2 from VP1__Norovirus__AGS08120

SEQ ID NO: 13968 - RNA, 1623 nt, Artificial Sequence; identical to SEQ ID NO: 13899
  derived and/or modified sequence opt2 from VP1__Norovirus__AGS08121

SEQ ID NO: 13969 - RNA, 1623 nt, Artificial Sequence
  derived and/or modified sequence opt2 from VP1__Norovirus__AGS08122
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcaacaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13970 - RNA, 1623 nt, Artificial Sequence
  derived and/or modified sequence opt2 from VP1__Norovirus__AGS08124
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacuccgacuucgucaccaaccagaacaccaaguucacccccgucggcgucauccaggacggcuccaccaccccccgcaacgagccccagcaguggguccuccccuccuacuccggccgcuccacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13971 - RNA, 1623 nt, Artificial Sequence
  derived and/or modified sequence opt2 from VP1__Norovirus__AGS08125
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgucuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13972 - RNA, 1623 nt, Artificial Sequence; identical to SEQ ID NO: 13909
  derived and/or modified sequence opt2 from VP1__Norovirus__AGS08126

SEQ ID NO: 13973 - RNA, 1623 nt, Artificial Sequence; identical to SEQ ID NO: 13444
  derived and/or modified sequence opt2 from VP1__Norovirus__AGS08127

SEQ ID NO: 13974 - RNA, 1623 nt, Artificial Sequence
  derived and/or modified sequence opt2 from VP1__Norovirus__AGS08128
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13975 - RNA, 1623 nt, Artificial Sequence
  derived and/or modified sequence opt2 from VP1__Norovirus__AGS08129
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcaugcucacccagaccacccgcaccgacggcuccacccgcggccacaaggccaccgucuacaccggcuccgucgacuucucccccaagcucggccgcguccaguucaccaccgacaccgacaacgacuucgagaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13976 - RNA, 1623 nt, Artificial Sequence
  derived and/or modified sequence opt2 from VP1__Norovirus__AGS08130
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccgacaacgacuucgucgccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13977 - RNA, 1623 nt, Artificial Sequence
  derived and/or modified sequence opt2 from VP1__Norovirus__AGS08131
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcaacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 13978 - RNA, 1623 nt, Artificial Sequence
  derived and/or modified sequence opt2 from VP1__Norovirus__AGS08132
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13979 - RNA, 1623 nt, Artificial Sequence
  derived and/or modified sequence opt2 from VP1__Norovirus__AGS08133
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccuccuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13980 - RNA, 1623 nt, Artificial Sequence
  derived and/or modified sequence opt2 from VP1__Norovirus__AGS08134
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacgucugcaccuuccgcggcgacgucacccacauccccggcucccacaacuacaccaugaaccucgccucccagaacuggaacuccuacgaccccaccgaggagauccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13981 - RNA, 1623 nt, Artificial Sequence
  derived and/or modified sequence opt2 from VP1__Norovirus__AGS08135
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13982 - RNA, 1623 nt, Artificial Sequence; identical to SEQ ID NO: 13899
  derived and/or modified sequence opt2 from VP1__Norovirus__AGS08136

SEQ ID NO: 13983 - RNA, 1623 nt, Artificial Sequence
  derived and/or modified sequence opt2 from VP1__Norovirus__AGS08137
augaagauggccuccuccgacgccaaccccuccgacggcuccuccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcgcccucuga

SEQ ID NO: 13984 - RNA, 1623 nt, Artificial Sequence; identical to SEQ ID NO: 13920
  derived and/or modified sequence opt2 from VP1__Norovirus__AGS08138

SEQ ID NO: 13985 - RNA, 1623 nt, Artificial Sequence
  derived and/or modified sequence opt2 from VP1__Norovirus__AGS08139
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13986 - RNA, 1623 nt, Artificial Sequence
  derived and/or modified sequence opt2 from VP1__Norovirus__AGS08140
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13987 - RNA, 1623 nt, Artificial Sequence
  derived and/or modified sequence opt2 from VP1__Norovirus__AGS08141
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 13988 - RNA, 1623 nt, Artificial Sequence
  derived and/or modified sequence opt2 from VP1__Norovirus__AGS08142
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcgccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccccuga

SEQ ID NO: 13989 - RNA, 1623 nt, Artificial Sequence; identical to SEQ ID NO: 13252
  derived and/or modified sequence opt2 from VP1__Norovirus__AGS08143

SEQ ID NO: 13990 - RNA, 1623 nt, Artificial Sequence
  derived and/or modified sequence opt2 from VP1__Norovirus__AGS08144
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13991 - RNA, 1623 nt, Artificial Sequence
  derived and/or modified sequence opt2 from VP1__Norovirus__AGS08145
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccacaacuacaccaugaaccucgccucccagaacuggaacuccuacgaccccaccgaggagacccccgccccccucggcacccccgacuucgucggcaagauccagggcguccucacccagaccaccuccaccaacggcuccacccgcggccacaaggccaccgucuacaccggcuccgccgacuucucccccaagcucggccgcguccaguucgccaccgacaccaacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13992 - RNA, 1623 nt, Artificial Sequence; identical to SEQ ID NO: 13951
  derived and/or modified sequence opt2 from VP1__Norovirus__AGS08146

SEQ ID NO: 13993 - RNA, 1623 nt, Artificial Sequence; identical to SEQ ID NO: 13292
  derived and/or modified sequence opt2 from VP1__Norovirus__AGS08147

SEQ ID NO: 13994 - RNA, 1623 nt, Artificial Sequence; identical to SEQ ID NO: 13899
  derived and/or modified sequence opt2 from VP1__Norovirus__AGS08148

SEQ ID NO: 13995 - RNA, 1623 nt, Artificial Sequence
  derived and/or modified sequence opt2 from VP1__Norovirus__AGS08149
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucuggaacgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggcaagugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13996 - RNA, 1623 nt, Artificial Sequence; identical to SEQ ID NO: 13945
  derived and/or modified sequence opt2 from VP1__Norovirus__AGS08150

SEQ ID NO: 13997 - RNA, 1623 nt, Artificial Sequence
  derived and/or modified sequence opt2 from VP1__Norovirus__AGS08152
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccgucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcgccaacggcuccacccgcggccacaaggccaccgucuacaccggcuccgccgacuucgcccccaagcucggccgcguccaguucgccaccgacaccaacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13998 - RNA, 1623 nt, Artificial Sequence
  derived and/or modified sequence opt2 from VP1__Norovirus__AGS08153
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccgucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccaacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 13999 - RNA, 1623 nt, Artificial Sequence
  derived and/or modified sequence opt2 from VP1__Norovirus__AGS08154
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgaggucgaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcacccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14000 - RNA, 1623 nt, Artificial Sequence; identical to SEQ ID NO: 13907
  derived and/or modified sequence opt2 from VP1__Norovirus__AGS08157

SEQ ID NO: 14001 - RNA, 1623 nt, Artificial Sequence
  derived and/or modified sequence opt2 from VP1__Norovirus__AGS08158
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucaucuga

SEQ ID NO: 14002 - RNA, 1623 nt, Artificial Sequence; identical to SEQ ID NO: 13911
  derived and/or modified sequence opt2 from VP1__Norovirus__AGS08160

SEQ ID NO: 14003 - RNA, 1623 nt, Artificial Sequence
  derived and/or modified sequence opt2 from VP1__Norovirus__AGS08161
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14004 - RNA, 1623 nt, Artificial Sequence
  derived and/or modified sequence opt2 from VP1__Norovirus__AGS08162
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14005 - RNA, 1623 nt, Artificial Sequence; identical to SEQ ID NO: 14004
  derived and/or modified sequence opt2 from VP1__Norovirus__AGS08163

SEQ ID NO: 14006 - RNA, 1623 nt, Artificial Sequence; identical to SEQ ID NO: 13909
  derived and/or modified sequence opt2 from VP1__Norovirus__AGS08164

SEQ ID NO: 14007 - RNA, 1623 nt, Artificial Sequence
  derived and/or modified sequence opt2 from VP1__Norovirus__AGS08165
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgaggucgaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14008 - RNA, 1623 nt, Artificial Sequence; identical to SEQ ID NO: 14004
  derived and/or modified sequence opt2 from VP1__Norovirus__AGS08166

SEQ ID NO: 14009 - RNA, 1623 nt, Artificial Sequence
  derived and/or modified sequence opt2 from VP1__Norovirus__AGS08167
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccaacgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14010 - RNA, 1623 nt, Artificial Sequence; identical to SEQ ID NO: 14007
  derived and/or modified sequence opt2 from VP1__Norovirus__AGS08168

SEQ ID NO: 14011 - RNA, 1623 nt, Artificial Sequence
  derived and/or modified sequence opt2 from VP1__Norovirus__AGS08169
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacauccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14012 - RNA, 1623 nt, Artificial Sequence; identical to SEQ ID NO: 14004
  derived and/or modified sequence opt2 from VP1__Norovirus__AGS08170

SEQ ID NO: 14013 - RNA, 1623 nt, Artificial Sequence
  derived and/or modified sequence opt2 from VP1__Norovirus__AGS08171
augaagauggccuccuccgacgccaaccccuccgacggcuccgccgccaaccucguccccgaggucaacaacgaggucauggcccucgaccccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14014 - RNA, 1623 nt, Artificial Sequence; identical to SEQ ID NO: 13909
  derived and/or modified sequence opt2 from VP1__Norovirus__AGS08172

SEQ ID NO: 14015 - RNA, 1623 nt, Artificial Sequence; identical to SEQ ID NO: 14007
  derived and/or modified sequence opt2 from VP1__Norovirus__AGS08173

SEQ ID NO: 14016 - RNA, 1623 nt, Artificial Sequence; identical to SEQ ID NO: 14004
  derived and/or modified sequence opt2 from VP1__Norovirus__AGS08174

SEQ ID NO: 14017 - RNA, 1623 nt, Artificial Sequence; identical to SEQ ID NO: 13903
  derived and/or modified sequence opt2 from VP1__Norovirus__AGS08175

SEQ ID NO: 14018 - RNA, 1623 nt, Artificial Sequence; identical to SEQ ID NO: 14004
  derived and/or modified sequence opt2 from VP1__Norovirus__AGS08176

SEQ ID NO: 14019 - RNA, 1623 nt, Artificial Sequence; identical to SEQ ID NO: 14007
  derived and/or modified sequence opt2 from VP1__Norovirus__AGS08177

SEQ ID NO: 14020 - RNA, 1623 nt, Artificial Sequence; identical to SEQ ID NO: 14004
  derived and/or modified sequence opt2 from VP1__Norovirus__AGS08178

SEQ ID NO: 14021 - RNA, 1623 nt, Artificial Sequence; identical to SEQ ID NO: 14004
  derived and/or modified sequence opt2 from VP1__Norovirus__AGS08179

SEQ ID NO: 14022 - RNA, 1623 nt, Artificial Sequence; identical to SEQ ID NO: 14004
  derived and/or modified sequence opt2 from VP1__Norovirus__AGS08180

SEQ ID NO: 14023 - RNA, 1623 nt, Artificial Sequence; identical to SEQ ID NO: 14007
  derived and/or modified sequence opt2 from VP1__Norovirus__AGS08181

SEQ ID NO: 14024 - RNA, 1623 nt, Artificial Sequence; identical to SEQ ID NO: 14007
  derived and/or modified sequence opt2 from VP1__Norovirus__AGS08182

SEQ ID NO: 14025 - RNA, 1647 nt, Artificial Sequence
  derived and/or modified sequence opt2 from VP1__Norovirus__AGT39181
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccgcgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14026 - RNA, 1608 nt, Artificial Sequence
  derived and/or modified sequence opt2 from VP1__Norovirus__AGT39191
augaagauggccuccaacgacgccgcccccuccaacgacggcgccgccggccucguccccgaggucaccaacgagaccauggcccucgagcccgucgcccgcgccuccaucgccgccccccucaccggccagaacaacgucaucgaccccuggaucacccucaacuucggccaggcccccaccggccaccucacccucuccccccccuacucccccggcgagguccuccucaaccucgagcuccgccccgagcucaaccccuaccucgccaaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcagaucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgaguccgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 14027 - RNA, 1608 nt, Artificial Sequence
  derived and/or modified sequence opt2 from VP1__Norovirus__AGT39194
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcagaucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgaguccgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 14028 - RNA, 1608 nt, Artificial Sequence
  derived and/or modified sequence opt2 from VP1__Norovirus__AGT39197
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggaggagaacgacguccacaucaaccagcccaccaaguucacccccgucggccucuucgaguccgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 14029 - RNA, 1608 nt, Artificial Sequence
  derived and/or modified sequence opt2 from VP1__Norovirus__AGT39200
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcagaucaccaacaucaacggcacccccuucggccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgaguccgagggcuucaaccaguggacccuccccaacuacuccggcgcccucacccucaacaugggccucgccccccccgucgcccccaccuuccccggcgagcagauccucuucuaccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 14030 - RNA, 1608 nt, Artificial Sequence; identical to SEQ ID NO: 13458
  derived and/or modified sequence opt2 from VP1__Norovirus__AGT39203

SEQ ID NO: 14031 - RNA, 1629 nt, Artificial Sequence
  derived and/or modified sequence opt2 from VP1__Norovirus__AGT39206
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcacaacacccccggccacaacgagcccgccaaccgcgcccacgacgccgucguccccaccuacaccgcccaguacacccccaagcucggccagauccagaucggcaccuggcagaccgacgaccucaccgucaaccagcccgucaaguucacccccgucggccucaacgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcacccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 14032 - RNA, 1623 nt, Artificial Sequence
  derived and/or modified sequence opt2 from VP1__Norovirus__AHF45991
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccuccacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14033 - RNA, 1623 nt, Artificial Sequence; identical to SEQ ID NO: 13252
  derived and/or modified sequence opt2 from VP1__Norovirus__AHF45993

SEQ ID NO: 14034 - RNA, 1623 nt, Artificial Sequence; identical to SEQ ID NO: 13909
  derived and/or modified sequence opt2 from VP1__Norovirus__AHF45997

SEQ ID NO: 14035 - RNA, 1623 nt, Artificial Sequence; identical to SEQ ID NO: 13909
  derived and/or modified sequence opt2 from VP1__Norovirus__AHF45999

SEQ ID NO: 14036 - RNA, 1623 nt, Artificial Sequence; identical to SEQ ID NO: 13909
  derived and/or modified sequence opt2 from VP1__Norovirus__AHF46001

SEQ ID NO: 14037 - RNA, 1617 nt, Artificial Sequence
  derived and/or modified sequence opt2 from VP1__Norovirus__AHH44876
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucuccgacaagaccuucgccaugaaccucgccucccccaacuggaacaacuacgaccccaccgaggacauccccgccccccucggcacccccgacuucgucggccgcauccacggcaugcucacccagaccacccgccgcgacggcgccacccgcggccacaaggccaccgucuccaccggcggcgccgacuucacccccaagcucggcuccguccgcuacaucaccgacaccaccgacgaccucgagguccgcgagaacaccaaguucacccccaucggcguccuccacuccuccggcgagcaccgcgccgagcccgaccaguggcgccuccccgaguacuccggccgcaacguccacaacguccaccucgcccccgccgucgcccccaccuuccccggcgagcagcuccucuucuuccgcuccgcccuccccggcugcggcggcuaccccaacaccgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14038 - RNA, 1617 nt, Artificial Sequence
  derived and/or modified sequence opt2 from VP1__Norovirus__AHH44877
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucgccggcgacaccuucgccaugaaccucgccucccucaacuggaacaacuacgaccccaccgaggagacccccgccccccucggcacccccgacuucgucggccgcauccacggcaugcucacccagaccacccgcuccgacggcgccacccgcgcccacaaggccaccgucuccaccggcggcgccgacuucacccccaagcucggcuccguccgcuacuccaccgacaccuccggcgaccucgagguccgcgagaacaccaaguucacccccaucggcguccuccacuccuccggcgagcgccgcgccgagcccgagcaguggcgccuccccgaguacuccggccgcaacguccacaacguccaccucgcccccgccgucgcccccaccuuccccggcgagcagcuccucuucuuccgcuccaccaugcccggcugcggcggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14039 - RNA, 1617 nt, Artificial Sequence
  derived and/or modified sequence opt2 from VP1__Norovirus__AHH44878
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucgccggcgacaccuucgccaugaaccucgccucccucaacuggaacaacuacgaccccaccgaggagacccccgccccccucggcacccccgacuucgucggccgcauccacggcaugcucacccagaccacccgcuccgacggcgccacccgcgcccacaaggccaccgucuccaccggcggcgccgacuucacccccaagcucggcuccguccgcuacuccaccgacaccuccuccgaccucgagguccgcgagaacaccaaguucacccccaucggcguccuccacuccuccggcggccaccgcgccgagcccgaccaguggcgccuccccgaguacuccggccgcaacguccacaacguccaccucgcccccgccgucgcccccaccuuccccggcgagcagcuccucuucuuccgcuccaccaugcccggcugcggcggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14040 - RNA, 1617 nt, Artificial Sequence
  derived and/or modified sequence opt2 from VP1__Norovirus__AHH44879
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucgccggcgacaccuucgccaugaaccucgccucccucaacuggaacaacuacgaccccaccgaggagacccccgccccccucggcacccccgacuucgucggccgcauccacggcaugcucacccagaccacccgcuccgacggcgccacccgcgcccacaaggccaccgucuccaccggcggcgccgacuucacccccaagcucggcuccguccgcuacuccaccgacaccuccuccgaccucgagguccgcgagaacaccaaguucacccccaucggcguccuccacuccuccggcggccaccgcgccgagcccgaccaguggcgccuccccgaguacuccggccgcaacguccacaacguccaccucgcccccgccgucgcccccaccuuccccggcgagcagcuccucuucuuccgcuccaccaugcccggcugcggcggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14041 - RNA, 1617 nt, Artificial Sequence
  derived and/or modified sequence opt2 from VP1__Norovirus__AHH44880
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaaggacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucgccggcgacaccuucgccaugaaccucgccucccucaacuggaacaacuacgaccccaccgaggagacccccgccccccucggcacccccgacuucgucggccgcauccacggcaugcucacccagaccacccgcuccgacggcgccacccgcgcccacaaggccaccgucuccaccggcggcgccgacuucacccccaagcucggcuccguccgcuacuccaccgacaccuccuccgaccucgagguccgcgagaacaccaaguucacccccaucggcguccuccacuccuccggcggccaccgcgccgagcccgaccaguggcgccuccccgaguacuccggccgcaacguccacaacguccaccucgcccccgccgucgcccccaccuuccccggcgagcagcuccucuucuuccgcuccaccaugcccggcugcggcggcuaccccaacauggaccucgacugccuccucccccaggaguggguccagcacuucuaccaggagaccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14042 - RNA, 1617 nt, Artificial Sequence
  derived and/or modified sequence opt2 from VP1__Norovirus__AHH44881
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucgccggcgacaccuucgccaugaaccucgccucccucaacuggaacaacuacgaccccaccgaggagacccccgccccccucggcacccccgacuucgucggccgcauccacggcaugcucacccagaccacccgcuccgacggcgccacccgcgcccacaaggccaccgucuccaccggcggcgccgacuucacccccaagcucggcuccguccgcuacuccaccgacaccuccuccgaccucgagguccgcgagaacaccaaguucacccccaucggcguccuccacuccuccggcggccaccgcgccgagcccgaccaguggcgccuccccgaguacuccggccgcaacguccacaacguccaccucgcccccgccgucgcccccaccuuccccggcgagcagcuccucuucuuccgcuccaccaugcccggcugcggcggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14043 - RNA, 1617 nt, Artificial Sequence
  derived and/or modified sequence opt2 from VP1__Norovirus__AHH44884
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaucaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccguccucaccgucgacgagaugaccaacucccgcuuccccaucccccucgagaagcucuucaccggccccuccuccgccuucgucguccagccccagaacggccgcugcaccaccgacggcguccuccucggcaccacccagcucuccgccgucaacaucugcaccuuccgcggcgacgucacccacgucuccgacaagaccuucgccaugaaccucgccucccccaacuggaacaacuacgaccccaccgaggagauccccgccccccucggcacccccgacuucgucggccgcauccacggcaugcucacccagaccacccgccgcgacggcgccacccgcggccacaaggccaccgucuccaccggcggcgccgacuucacccccaagcucggcuccguccgcuacaucaccgacaccaccgacgaccucgagguccgcgagaacaccaaguucacccccaucggcguccuccacuccuccggcgagcaccgcgccgagcccgaccaguggcgccuccccgaguacuccggccgcaacguccacaacguccaccucgcccccgccgucgcccccaccuuccccggcgagcagcuccucuucuuccgcuccgcccuccccggcugcggcggcuaccccaacaccgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14044 - RNA, 1620 nt, Artificial Sequence
  derived and/or modified sequence opt2 from VP1__Norovirus__AHH44886
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14045 - RNA, 1620 nt, Artificial Sequence
  derived and/or modified sequence opt2 from VP1__Norovirus__AHH44888
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcaacauccgcuucuccaccgacaccaacaacgacuucgaggccggccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14046 - RNA, 1620 nt, Artificial Sequence
  derived and/or modified sequence opt2 from VP1__Norovirus__AHH44889
augaagauggccuccaacgacgccucccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcaucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14047 - RNA, 1620 nt, Artificial Sequence; identical to SEQ ID NO: 14045
  derived and/or modified sequence opt2 from VP1__Norovirus__AHH44890

SEQ ID NO: 14048 - RNA, 1620 nt, Artificial Sequence; identical to SEQ ID NO: 14045
  derived and/or modified sequence opt2 from VP1__Norovirus__AHH44891

SEQ ID NO: 14049 - RNA, 1620 nt, Artificial Sequence; identical to SEQ ID NO: 14045
  derived and/or modified sequence opt2 from VP1__Norovirus__AHH44893

SEQ ID NO: 14050 - RNA, 1620 nt, Artificial Sequence
  derived and/or modified sequence opt2 from VP1__Norovirus__AHH44894
augaagauggccuccaacgacgccucccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcuccauccgcuucuccaccgacaccaacaacgacuucgaggccucccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14051 - RNA, 1620 nt, Artificial Sequence
  derived and/or modified sequence opt2 from VP1__Norovirus__AHH44895
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacugggacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcaacauccgcuucuccaccgacaccaacaacgacuucgaggccggccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14052 - RNA, 1620 nt, Artificial Sequence; identical to SEQ ID NO: 14045
  derived and/or modified sequence opt2 from VP1__Norovirus__AHH44896

SEQ ID NO: 14053 - RNA, 1620 nt, Artificial Sequence; identical to SEQ ID NO: 14045
  derived and/or modified sequence opt2 from VP1__Norovirus__AHH44897

SEQ ID NO: 14054 - RNA, 1620 nt, Artificial Sequence; identical to SEQ ID NO: 14045
  derived and/or modified sequence opt2 from VP1__Norovirus__AHH44899

SEQ ID NO: 14055 - RNA, 1620 nt, Artificial Sequence
  derived and/or modified sequence opt2 from VP1__Norovirus__AHH44900
augaagauggccuccaacgacgccucccccuccgacggcuccgccgccaaccucguccccgaggucaacaacgaggucauggcccucgagcccgucgucggcgccaccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucucccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcaacauccgcuucuccaccgacaccaacaacgacuucgaggccggccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14056 - RNA, 1620 nt, Artificial Sequence; identical to SEQ ID NO: 14045
  derived and/or modified sequence opt2 from VP1__Norovirus__AHH44902

SEQ ID NO: 14057 - RNA, 1620 nt, Artificial Sequence
  derived and/or modified sequence opt2 from VP1__Norovirus__AHH44904
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucucccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucaccggcaccuccgaguacgccaugaaccucgccucccagaacuggaacaacuacgaccccaccgaggagauccccgccccccucggcgcccccgacuucgucggcaagauccgcggcaugcucacccagaccacccgccgcgacggcuccacccgcggccaccgcgccacccucuccaccggcuccgcccacuucacccccaagcucggcaacauccgcuucuccaccgacaccaacaacgacuucgaggccggccagaacaccaaguucacccccgucggcgucuuccaggagggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcggcggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14058 - RNA, 1620 nt, Artificial Sequence; identical to SEQ ID NO: 14045
  derived and/or modified sequence opt2 from VP1__Norovirus__AHH44905

SEQ ID NO: 14059 - RNA, 1620 nt, Artificial Sequence
  derived and/or modified sequence opt2 from VP1__Norovirus__AHH44906
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccuacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgaccucacccacuucgccggcaccuccgaguacgccaugaaccucgccucccagaacuggaccaacuacgaccccaccgaggagauccccgccccccucggcgcccccgacuucgucggcaagauccgcggcguccucacccagaccacccgcggcgacggcuccacccgcggccaccgcgccacccucuccaccggcuccgcccacuucacccccaagcucggcuccguccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14060 - RNA, 1620 nt, Artificial Sequence
  derived and/or modified sequence opt2 from VP1__Norovirus__AHH44907
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaaguucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucgccggcacccacgaguacgccaugaaccucgccucccagaacuggaacaacuacgaccccaccgaggagauccccgccccccucggcgcccccgacuucgucggcaagauccgcggcguccucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgcugcgcccucuga

SEQ ID NO: 14061 - RNA, 1620 nt, Artificial Sequence
  derived and/or modified sequence opt2 from VP1__Norovirus__AHH44908
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgaccucacccacuucgccggcaccuccgaguacgccaugaaccucgccucccagaacuggaccaacuacgaccccaccgaggagauccccgccccccucggcgcccccgacuucgucggcaagauccgcggcguccucacccagaccacccgcggcgacggcuccacccgcggccaccgcgccacccucuccaccggcuccgcccacuucacccccaagcucggcuccguccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14062 - RNA, 1620 nt, Artificial Sequence
  derived and/or modified sequence opt2 from VP1__Norovirus__AHH44909
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccugggaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucgccggcacccacgaguacgccaugaaccucgccucccagaacuggaacaacuacgaccccaccgaggagauccccgccccccucggcgcccccgacuucgucggcaagauccgcggcguccucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14063 - RNA, 1620 nt, Artificial Sequence
  derived and/or modified sequence opt2 from VP1__Norovirus__AHH44911
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucgccggcacccacgaguacgccaugaaccucgccucccagaacuggaacaacuacgaccccaccgaggagauccccgccccccucggcgcccccgacuucgucggcaagauccgcggcguccucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14064 - RNA, 1620 nt, Artificial Sequence
  derived and/or modified sequence opt2 from VP1__Norovirus__AHH44912
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgaccucacccacuucgccggcacccacgaguacgccaugaaccucgccucccagaacugguccaacuacgaccccaccgaggagauccccgccccccucggcgcccccgacuucgucggcaagauccgcggcguccucacccagaccacccgcggcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccgacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14065 - RNA, 1620 nt, Artificial Sequence
  derived and/or modified sequence opt2 from VP1__Norovirus__AHH44913
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgaccucacccacuucgccggcaccuccgaguacgccaugaaccucgccucccagaacuggaccaacuacgaccccaccgaggagauccccgccccccucggcgcccccgacuucgucggcaagauccgcggcguccucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucacccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14066 - RNA, 1620 nt, Artificial Sequence
  derived and/or modified sequence opt2 from VP1__Norovirus__AHH44914
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgaccucacccacuucgccggcacccacgaguacgccaugaaccucgccucccagaacuggaccaacuacgaccccaccgaggagauccccgccccccucggcgcccccgacuucgucggcaagauccgcggcguccucacccagaccacccgcggcgacggcuccacccgcggccaccgcgccacccucuccaccggcuccgcccacuucacccccaagcucggcuccguccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14067 - RNA, 1620 nt, Artificial Sequence
  derived and/or modified sequence opt2 from VP1__Norovirus__AHH44915
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaaggaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcuccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgaccucacccacuucgccggcaccuccgaguacgccaugaaccucgccucccagaacuggaccaacuacgaccccaccgaggagauccccgccccccucggcgcccccgacuucgucggcaagauccgcggcguccucacccagaccacccgccgcgacggcuccacccgcggccaccgcgccacccucuccaccggcuccgcccacuucacccccaagcucggcuccauccgcuucuccaccgacaccaacaacgacuucgaggccggccagaacaccaaguucacccccgucggcgucuuccaggacggcgacaaccaccagaacgagccccagcaguggguccuccccaacuacuccggcgccaccgcccacaacguccaccucgcccccgccgucgcccccgccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccucccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14068 - RNA, 1623 nt, Artificial Sequence; identical to SEQ ID NO: 13855
  derived and/or modified sequence opt2 from VP1__Norovirus__AID60853

SEQ ID NO: 14069 - RNA, 1623 nt, Artificial Sequence; identical to SEQ ID NO: 13903
  derived and/or modified sequence opt2 from VP1__Norovirus__AID60855

SEQ ID NO: 14070 - RNA, 1623 nt, Artificial Sequence; identical to SEQ ID NO: 13903
  derived and/or modified sequence opt2 from VP1__Norovirus__AID60857

SEQ ID NO: 14071 - RNA, 1623 nt, Artificial Sequence; identical to SEQ ID NO: 13903
  derived and/or modified sequence opt2 from VP1__Norovirus__AID60859

SEQ ID NO: 14072 - RNA, 1623 nt, Artificial Sequence
  derived and/or modified sequence opt2 from VP1__Norovirus__AID60861
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14073 - RNA, 1623 nt, Artificial Sequence
  derived and/or modified sequence opt2 from VP1__Norovirus__AID60863
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14074 - RNA, 1623 nt, Artificial Sequence
  derived and/or modified sequence opt2 from VP1__Norovirus__AID60865
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacgucgucaucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14075 - RNA, 1623 nt, Artificial Sequence
  derived and/or modified sequence opt2 from VP1__Norovirus__AID60869
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccaacggcuccacccgcggccacaaggccaccgucuacgccggcuccgccaacuucgcccccaagcucggccgcguccaguucgagaccgacaccgaccacgaccucgaggccaaccagaacaccaaguucacccccgucggcgucauccaggacggcaacaccacccaccgcaacgagccccagcaguggguccuccccuccuacuccggccgcuccacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14076 - RNA, 1623 nt, Artificial Sequence
  derived and/or modified sequence opt2 from VP1__Norovirus__AID60871
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14077 - RNA, 1623 nt, Artificial Sequence
  derived and/or modified sequence opt2 from VP1__Norovirus__AID60875
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgaguccugggucaaccaguucuacacccucgcccccaugggcaacggcaccggccgccgccgcgcccucuga

SEQ ID NO: 14078 - RNA, 1623 nt, Artificial Sequence
  derived and/or modified sequence opt2 from VP1__Norovirus__AID60877
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14079 - RNA, 1623 nt, Artificial Sequence; identical to SEQ ID NO: 14078
  derived and/or modified sequence opt2 from VP1__Norovirus__AID60879

SEQ ID NO: 14080 - RNA, 1623 nt, Artificial Sequence
  derived and/or modified sequence opt2 from VP1__Norovirus__AID60881
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccauccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14081 - RNA, 1623 nt, Artificial Sequence
  derived and/or modified sequence opt2 from VP1__Norovirus__AID60883
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccaucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgaccucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccauccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14082 - RNA, 1623 nt, Artificial Sequence; identical to SEQ ID NO: 14078
  derived and/or modified sequence opt2 from VP1__Norovirus__AID60885

SEQ ID NO: 14083 - RNA, 1623 nt, Artificial Sequence
  derived and/or modified sequence opt2 from VP1__Norovirus__AID60887
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14084 - RNA, 1623 nt, Artificial Sequence
  derived and/or modified sequence opt2 from VP1__Norovirus__AID60889
augaagauggccuccuccgacgccaaccccugcgacggcuccgccgccaaccucguccccgaggucaacaacgaggucauggcccucgagcccgucgucggcgccgccaucgccgcccccgucggcggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccacccuccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14085 - RNA, 1623 nt, Artificial Sequence
  derived and/or modified sequence opt2 from VP1__Norovirus__AID60893
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaccccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccacccuccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14086 - RNA, 1623 nt, Artificial Sequence
  derived and/or modified sequence opt2 from VP1__Norovirus__AID68577
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14087 - RNA, 1623 nt, Artificial Sequence
  derived and/or modified sequence opt2 from VP1__Norovirus__AID68578
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcauccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14088 - RNA, 1623 nt, Artificial Sequence
  derived and/or modified sequence opt2 from VP1__Norovirus__AID68579
augaagauggccuccuccgacgccaaccccuccgacggcuccgccgccaaccucguccccgaggucaacaacgagguccucgcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcauccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14089 - RNA, 1623 nt, Artificial Sequence; identical to SEQ ID NO: 13911
  derived and/or modified sequence opt2 from VP1__Norovirus__AID68581

SEQ ID NO: 14090 - RNA, 1623 nt, Artificial Sequence
  derived and/or modified sequence opt2 from VP1__Norovirus__AID69174
augcgcauggccuccgacgacgccaaguccgcccccuccgaccucgagggcgccggccucguccccgccaccgccgccccccuccccgucgcccccgucgccggcgcccaggccgccgagcccuucgccggccagaucaacgucaucgaccccuggaucuacaccaacuucguccaggcccccaccggcgaguucaccgucuccccccgcaacacccccggcgagguccucgucaaccucgagaucggccccaaccucaaccccuaccuccagcaccucgcccagauguacaacggcuacgccggcggcgucgagguccaggucauccucgccggcaacgccuucaccgccggcaagcuccucugcgcccucgucccccccggcuuccccaccuccuccaucacccccgcccagcucaccaugcucccccacaccaucaucgacguccgcaccaccgaccccgucgucguccccaugcccgacguccgccgcacccucuggcacgagguccgcuccaccaccgagccccucaugcgccucgucaucaugcucuacacccccaugcgcgccaacuccggcuccgacgaggccuucgucgucuccggccgcguccucucccgccccgcccccgacuucaacuucuucuaccucguccccccccgcgucgaggacaccgucgagcccuucucccuccccgaccuccgcgucgacgagauguccuccucccgcuggcagaaccccgucgucaugcuccaggccgaccccaaccagaacaucgccgcccacuggcagaacggccgcugcaccaucaacggcgagcuccucggcaccaccccccgcaaccaguccuggcuccuccgcaugcgcggcuccguccucgccgcccccggcggccagaaggccgucaccgucaacgucgaccucaccgagcccgacggccaggccuucuccguccucuccggcaaccccggccccgagggcguccccgacuuccaggccaucuacaacguccgcauguccaccgccuccaccaccgccggccacaccgucgccaccaacggcuacaucgagcaguccggcuacacccccgcccucggcacccucgucauccagggcgucgaccucucccagguccccgcccucggcuccgaggucaccaugcaggucgucuccaucgaccucaaccacaacauggaccccacccgccuccccgacuacaacggcgccggcuucgacggcuccgucgcccucgcccccccccucguccccccccuccccggcgagguccuccuccgcuucaccacccuccccaucaccaccucccgcggcuccuccgucuccgccacccucgacugcgcccuccccgccgaguggaucaccugguuccucguccacaacuucgucccccagggcgacgccgcccuccuccgcuaccgcaaccgcggcaccggccagauccucuucgagugcaagcucuacaaggagggcuuccucgccgucgccggcgucuccacccgcaccgucuuccccaccuccggcgucuucgaguucgucuccuggguccccgucuucuaccagcucacccccgucggcuccuccggcgcccgcaagcgccagcgcuga

SEQ ID NO: 14091 - RNA, 1623 nt, Artificial Sequence
  derived and/or modified sequence opt2 from VP1__Norovirus__AIG59994
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14092 - RNA, 1623 nt, Artificial Sequence
  derived and/or modified sequence opt2 from VP1__Norovirus__AIG59996
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14093 - RNA, 1623 nt, Artificial Sequence; identical to SEQ ID NO: 13855
  derived and/or modified sequence opt2 from VP1__Norovirus__AIG59998

SEQ ID NO: 14094 - RNA, 1623 nt, Artificial Sequence
  derived and/or modified sequence opt2 from VP1__Norovirus__AIG60000
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggccacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14095 - RNA, 1623 nt, Artificial Sequence
  derived and/or modified sequence opt2 from VP1__Norovirus__AIG60002
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgccgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaucaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14096 - RNA, 1623 nt, Artificial Sequence; identical to SEQ ID NO: 13855
  derived and/or modified sequence opt2 from VP1__Norovirus__AIG60004

SEQ ID NO: 14097 - RNA, 1623 nt, Artificial Sequence; identical to SEQ ID NO: 13855
  derived and/or modified sequence opt2 from VP1__Norovirus__AIG60006

SEQ ID NO: 14098 - RNA, 1623 nt, Artificial Sequence
  derived and/or modified sequence opt2 from VP1__Norovirus__AIG60008
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14099 - RNA, 1623 nt, Artificial Sequence; identical to SEQ ID NO: 13909
  derived and/or modified sequence opt2 from VP1__Norovirus__AIG60010

SEQ ID NO: 14100 - RNA, 1623 nt, Artificial Sequence; identical to SEQ ID NO: 13855
  derived and/or modified sequence opt2 from VP1__Norovirus__AIG60012

SEQ ID NO: 14101 - RNA, 1623 nt, Artificial Sequence
  derived and/or modified sequence opt2 from VP1__Norovirus__AIG60014
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14102 - RNA, 1623 nt, Artificial Sequence; identical to SEQ ID NO: 13903
  derived and/or modified sequence opt2 from VP1__Norovirus__AIG60016

SEQ ID NO: 14103 - RNA, 1623 nt, Artificial Sequence; identical to SEQ ID NO: 13855
  derived and/or modified sequence opt2 from VP1__Norovirus__AIG60018

SEQ ID NO: 14104 - RNA, 1623 nt, Artificial Sequence
  derived and/or modified sequence opt2 from VP1__Norovirus__AIG60020
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggcaucguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14105 - RNA, 1623 nt, Artificial Sequence; identical to SEQ ID NO: 13855
  derived and/or modified sequence opt2 from VP1__Norovirus__AIG60022

SEQ ID NO: 14106 - RNA, 1623 nt, Artificial Sequence; identical to SEQ ID NO: 13909
  derived and/or modified sequence opt2 from VP1__Norovirus__AIG60024

SEQ ID NO: 14107 - RNA, 1629 nt, Artificial Sequence
  derived and/or modified sequence opt2 from VP1__Norovirus__AII73717
augaagauggccuccaacgacgccgcccccuccaacgacggcgccgccucccucguccccgagggcaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaccaacgucguccagugccagaacggccgcugcacccucgacggcgagcuccagggcaccacccagcuccucuccuccgccgucugcuccuaccgcggccgcaccgucgccaacaacggcgacaacugggaccagaaccuccuccagcucaccuaccccaacggcgccuccuacgaccccaccgacgagguccccgccccccucggcacccaggacuucuccggcaugcucuacggcguccucacccaggacaacgucaacgucuccaccggcgaggccaagaacgccaagggcaucuacaucuccaccaccuccggcaaguucacccccaagaucggcuccaucggccuccacuccaucaccgagcacguccaccccaaccagcagucccgcuucacccccgucggcgucgccgucaacgagaacacccccuuccagcaguggguccucccccacuacgccggcucccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcauccaguga

SEQ ID NO: 14108 - RNA, 1623 nt, Artificial Sequence
  derived and/or modified sequence opt2 from VP1__Norovirus__AII73720
augaagauggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccucccagaucaccauguucccccacgucaucgucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagcuccaggccugcaacaucugcuccauccgcggcaaggucaccggccagguccccaacgagcagcacauguggaaccucgagaucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuccugggucaaccaguucuacucccucgcccccaugggcaccggcaacggccgccgccgcuuccaguga

SEQ ID NO: 14109 - RNA, 1611 nt, Artificial Sequence
  derived and/or modified sequence opt2 from VP1__Norovirus__AII73723
augaagauggccuccaacgacgccacccccuccgacgacggcgccgccggccucguccccgagaucaacuccgaggucauggcccucgagcccgucgccggcgccuccaucgccgcccccgucgucggccagcagaacaucaucgaccccuggauccgcaacaacuucguccaggcccccgccggcgaguucaccgucuccccccgcaacucccccggcgagcuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgccaucccccccuccuuccccuacgagaaccucucccccgcccagcucaccaugugcccccacgucaucgucgacguccgccagcucgagcccguccuccuccccaugcccgacauccgcaacgucuucuaccacuacaaccagaacaacucccccaagcuccgccucgucgccaugcucuacaccccccuccgcgccaacaacuccggcgacgacgucuucaccgucuccugccgcguccucacccgccccucccccgacuuccaguucaccuuccucgucccccccaccgucgaguccaagaccaagaacuucacccuccccguccuccgcgucuccgagaugaccaacucccgcuuccccgucguccucgaccagauguacaccucccgcaacgagaacaucaucguccagccccagaacggccgcugcaccaccgacggcgagcuccucggcaccaccauccuccaguccgucuccaucugcaacuucaagggcaccaugcaggccaagcucaacgaggagccccgcuaccagcuccagcucaccaaccucgacggcucccccaucgaccccaccgacgacaugcccgccccccucggcacccccgacuuccaggccguccucuacggcgucgccucccagcgcuccucccgcgacaacgccacccgcgcccacgacgcccagaucgacaccgccggcgacaccuucgcccccaagaucggccagguccgcuucaaguccuccuccaacgacuucgaccuccacgaccccaccaaguucacccccaucggcgucaacgucgacgaccagcaccccuuccgccaguggucccuccccaacuacggcggccaccucgcccucaacaaccaccucgcccccgccgucaccccccucuuccccggcgagcagauccucuucuuccgcuccuacauccccuccgccggcggccacaccgacggcgccauggacugccuccucccccaggagugggucgagcacuucuaccaggaggccgcccccucccaguccgacaucgcccucguccgcuucaucaaccccgacaccggccgcguccucuucgaggccaagcuccacaagcagggcuuccucaccaucgccgccuccggcgaccaccccaucgucaugcccaccaacggcuacuuccgcuucgaggccugggucaaccccuucuacacccucgcccccgucggcaccggcuccggccgccgccgcauccaguga

SEQ ID NO: 14110 - RNA, 1623 nt, Artificial Sequence; identical to SEQ ID NO: 13855
  derived and/or modified sequence opt2 from VP1__Norovirus__AII73726

SEQ ID NO: 14111 - RNA, 1623 nt, Artificial Sequence; identical to SEQ ID NO: 13855
  derived and/or modified sequence opt2 from VP1__Norovirus__AII73729

SEQ ID NO: 14112 - RNA, 1623 nt, Artificial Sequence; identical to SEQ ID NO: 13855
  derived and/or modified sequence opt2 from VP1__Norovirus__AII73732

SEQ ID NO: 14113 - RNA, 1608 nt, Artificial Sequence
  derived and/or modified sequence opt2 from VP1__Norovirus__AII73735
augaagauggccuccuccgacgccgcccccuccaacgacggcgccgccggccucguccccgaggccaacaacgagaccauggcccucgagcccgucgccggcgccuccaucgccgccccccucaccggccagaacaacaucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucuccccccgcgaccacgacaacgccugccgcucccacgacgccgucaucgccaccaacuccgccaaguucacccccaagcucggcgccauccagaucggcaccugggaggagaacgacguccacaucaaccagcccaccaaguucacccccgucggccucuucgaggacgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 14114 - RNA, 1623 nt, Artificial Sequence; identical to SEQ ID NO: 13909
  derived and/or modified sequence opt2 from VP1__Norovirus__AII73738

SEQ ID NO: 14115 - RNA, 1620 nt, Artificial Sequence
  derived and/or modified sequence opt2 from VP1__Norovirus__AII73741
augaagauggccuccaacgacgccgcccccuccaacgacggcgccaccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacaucgucguccagccccagaacggccgcugcacccucgacggcgagcuccagggcaccacccagcuccucaccaccgccaucugcuccuaccgcggcaugaccuccaaccccaccuccgacuacugggacgaccaccuccuccaccucguccaccccaacggcgccaccuacgaccccaccgaggacguccccgcccccuucggcacccaggacuuccgcggcauccucuacggcaugcucacccagaacccccgcaccuccggcgacgaggccgccaacucccacggcaucuacaucuccuccaccuccgagaaguucacccccaagcucggcaccaucggccuccaccagguccagggcgacaucgccuccaaccagcaguccaaguucacccccgucggcaucgccgucaacggcaacacccccuuccgccagugggagcuccccaacuacuccggcgcccucacccucaacaccaaccucgcccccgccgucggccccaacuuccccggcgagcagauccucuucuuccgcuccaacguccccuccguccagggcggccagcccaucgagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacuccugggucaaccaguucuacgcccucgcccccaugggcaccggcaacggccgccgccgcguccaguga

SEQ ID NO: 14116 - RNA, 1623 nt, Artificial Sequence; identical to SEQ ID NO: 13252
  derived and/or modified sequence opt2 from VP1__Norovirus__AII73744

SEQ ID NO: 14117 - RNA, 1623 nt, Artificial Sequence
  derived and/or modified sequence opt2 from VP1__Norovirus__AII73747
augaagauggccuccaacgacgccgcccccuccaacgacggcgccaccggccucguccccgagaucaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccgccaaccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucaccaucuccgagcucaccaacucccgcuuccccgcccccaucgacucccucuucaccgcccagaacaacaaccucaacguccagugccagaacggccgcugcacccucgacggcgagcuccagggcaccacccagcuccuccccuccggcaucugcgccuuccgcggccgccucaccgccgacgucgacggcucccacgacgaccgcuggcacaugcagcucaccaaccucaacggcacccccuucgaccccaccgaggacguccccgccccccucggcacccccgacuucaccggccuccucuucggcgucgccucccagcgcaacgucggcuccaaccccaacaccacccgcgcccacgaggccgucaucuccaccaccuccucccaguucguccccaagcucggcuccgucaacuucggcuccaccuccaccgacuuccagcuccagcagcccaccaaguucacccccgucggcaucaagaucgaguccggccacgaguucgaccagugggcccucccccgcuacuccggccaccucacccucaacaugaaccucgccccccccaucgcccccaacuuccccggcgagcagcuccucuucuuccgcuccaacguccccugcgccggcggcgucuccgacggcgucaucgacugccuccucccccaggaguggauccagcacuucuaccaggaguccgcccccucccaguccgacgucgcccucauccgcuacgucaaccccgacaccggccgcacccucuucgaggccaagcuccaccgcaccggcuacaucaccgucgcccacuccggcgacuacccccucgucguccccuccaacggcuacuuccgcuucgacuccugggucaaccaguucuacucccucgcccccaugggcaccggcaacggccgccgccgcguccaguga

SEQ ID NO: 14118 - RNA, 1623 nt, Artificial Sequence
  derived and/or modified sequence opt2 from VP1__Norovirus__AII73750
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggccacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14119 - RNA, 1623 nt, Artificial Sequence
  derived and/or modified sequence opt2 from VP1__Norovirus__AII73753
augaagauggccuccaacgacgccacccccuccaacgacggcgccgccggccucguccccgaguccaacaacgaggccauggcccucgagcccgucgucggcgccucccucgccgcccccgucaccggccagaccaacaucaucgaccccuggauccgcaccaacuucguccaggcccccaacggcgaguucaccgucuccccccgcaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccucccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagcuccaggccugcaacaucugcuccauccgcggcaaggucaccggccagguccccaacgagcagcacauguggaaccuccagaucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacgucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuccugggucaaccaguucuacucccucgcccccaugggcaccggcaacggccgccgccgcuuccaguga

SEQ ID NO: 14120 - RNA, 1623 nt, Artificial Sequence; identical to SEQ ID NO: 13252
  derived and/or modified sequence opt2 from VP1__Norovirus__AII73756

SEQ ID NO: 14121 - RNA, 1668 nt, Artificial Sequence
  derived and/or modified sequence opt2 from VP1__Norovirus__AII73759
augcgcauggccuccuccgacgcccccgucuccggcaccgacggcgccgccggccucguccccgagucccagcaggagguccucccccucgagcccgucgccggcguccagcucgccgcccccgucgccggccaguccaacaucaucgaccccuggauccgcaugaacuucguccaggcccccgccggcgaguucaccgucuccccccgcaacgcccccggcgagguccucaucgaccucgagcucggccccgagcucaaccccuaccucaaccaccucgcccgcauguacaacggcuacgucggcggcauggaggucgaggucguccucgccggcaacgccuucaccgccggcaagauccucuucgccgccgucccccccuccuuccccacccacggcaucuccgccgcccaggccaccaugcucccccacgucaucgucgacguccgccagcucgagcccguccgccucccccuccccgacguccgcaacgucauguuccacuucugccaggagaacaaggagccccgcaugcgcaucgucgccauccucuacaccccccuccgcgccaacggcgccggcgacgacgucuucaccgucuccugccgcguccucacccgccccucccccgacuucgacuucaucuuccucgucccccccuccgucgaguccaagcucaagcaguucacccuccccaaccuccagcccaacgagaugaccaacucccgcuuccccaccggcaucacccagcucuacaccucccccaacaccaaccucgucguccaguuccagaacggccgcugccuccucgacggcacccuccucggcaccacccccguccgcgccgccgacaucugcuccuuccgcggcgucaccuccaccgaggucgacgccaccgacuccccccgcgucgccggcucccaccgcaucaugguccagcuccgcgagcccgacggcgaggaguucucccccaccggccccaaccccgcccccgucggcacccccgacuuccaggccgccaucuucggcacccucucccagcgcaacaccggcggcgccggccagaacuccaaccgcgcccacuucgccuacuucuacacccgcaaccccaccuucgcccccggcaucggcaccgucgucuucuccuucgacaccaccgacuuccagaaccgccagcccaccaaguucucccccuccggcgucuucgacgacgacuccuccgagcccuucaaccaguucucccuccccuacuacaacggcucccucggcgccgucgacgccggcaagcucgccccccccgucgcccccaacuaccccggcgagcagauccucuacuuccgcggcuccguccccuucaagggcggcuacggcgagggcgagaucgacucccuccucccccaggaguggaucacccacuucuacgccgagcaggcccccacccagggcgacgccgcccuccuccgcuacuacaaccccgacaccggccgcguccucuucgagugcaagcuccaccgcgagggcuucaucaccaucaacuacaccggcuccaacgcccucgccguccccgucaacggcgucuuccgcuucgagggcugggucaacaaguucuacacccucacccccaugggcaacggcaacggccgccgcggccgccgccgcgagcucuga

SEQ ID NO: 14122 - RNA, 1668 nt, Artificial Sequence
  derived and/or modified sequence opt2 from VP1__Norovirus__AII73762
augaagauggccuccaaggacgccucccccuccaccgacggcaccgccaaccucguccccgagucccagcaggagguccucgcccuccagcccgucgccggcgcccagaucgccgcccccgucgccggccaguucaacgucaucgaccccuggaucuaccagaacuucguccaggcccccgagggcgaguucaccgucuccccccgcaacuccaccggcgagauccucaugaaccucgagcucggcccccagcucaaccccuaccucgcccaccucgcccgcauguacaacgccuacgccggcggcuucgagguccagguccuccucgccggcaacgccuucaccgccggcaagaucaucgucugcgccgucccccccaacuucccccuccagaacaucuccgccgcccaggccacccagcucccccacgucgucgucgacguccgccagcucgagcccgucguccucccccuccccgacguccgcgccggcuucuaccacuacaaccaggucgaggagucccgcaugcgccucgucgccauccucuacaccccccuccgcaccaacuccgccggcgacgacgccuucaccgucuccugccgcauccucacccgccccgcccccgacuucuccuucuucuuccucaucccccccaccaucgaguccaagaccacccccuucacccucccccgccuccccaucuccgagaugaccaacucccgcuucccccucgucaucaagggcauggucgucgaccccaaccucccccuccaggccaacuuccagaacggccgcaucacccucgacggcgagcuccagggcaccacccuccccaccuccaccuccaucggccgcaucuccggcacccacauguccuccacccccucccgcaucauccagcacgaggacuccggcgacuccacccagccccgcgucuucaaccccgucuggauggaccucaccgagaacaacuggaccgaguuccagcccuucaacgaccagcccgccccccucggcugccccgacuucaaggccaagauccucggcacccucauccgccagcccaacaacggcuccuacuacuucgacgccuaccucgacacccgccagcacggcaccuucgcccccuacaccggccacgccgccguccacuccgaccagcaggccggccaccucgcccagggcuacaagauccaguucucccccaccggcaucgaguccgaccagaacaccgaccucaaccagcuccccgacuacggcggcgccaugaccgucuccaagggccucgcccccgccgccgcccccgacuuccccggcgagaugauccucuacuucgucuccgacaugcccguccgcaaccccaacggcgagcgccgcgacaccgagauccucugccuccucccccaggagauggucacccacuucuacgagcagcaggcccccucccagggcgacgucgcccucguccgcuacaucaacgccgagaccggccgcgucauguucgagggcaagcuccaccgcaacggcuucuucaccgucuccgccaccgcccgcacccucaucguccccgacggcuacuuccgcuucgacuccugggucaaccgcuucuacacccucucccccaugggcaccggcaacggccgccgccgcgcccgcaugcucgaguga

SEQ ID NO: 14123 - RNA, 1638 nt, Artificial Sequence
  derived and/or modified sequence opt2 from VP1__Norovirus__AII73765
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgucgcccagaacgucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucaacaccggcgacgucaucaagcagaucaacgucaagcaggaguccgccuucgccccccaccucggcaccauccaggccgacggccucuccgacgucuccgucaacaccaacaugaucgccaagcucggcugggucucccccgucuccgacggccacaagggcgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacuccuccggcaccggcccccagacccuccccaucaacggcgucuucgucuucgucuccugggucucccgcuucuaccagcucaagcccgucggcaccgccggccccgcccgccgccucggcauccgccgcuccuga

SEQ ID NO: 14124 - RNA, 1623 nt, Artificial Sequence; identical to SEQ ID NO: 13855
  derived and/or modified sequence opt2 from VP1__Norovirus__AII73768

SEQ ID NO: 14125 - RNA, 1608 nt, Artificial Sequence
  derived and/or modified sequence opt2 from VP1__Norovirus__AII73771
augaagauggccuccuccgacgccgcccccuccaacgacggcgccgccggccucguccccgaggccaacaacgagaccauggcccucgagcccgucgccggcgccuccaucgccgccccccucaccggccagaacaacaucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcauccucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgagaacgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 14126 - RNA, 1623 nt, Artificial Sequence
  derived and/or modified sequence opt2 from VP1__Norovirus__AII73774
augaagauggccuccaacgacgccgcccccuccaacgacggcgccgccggccucguccccgagaucaacaacgaggucaugccccucgagcccgucgccggcgccucccucgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuuccccuacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucaucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgagaugauguacaccgcccgcaacgagaaccaggucguccagccccagaacggccgcgucacccucgacggcgagcuccucggcaccaccccccuccucgccgucaacaucugcaaguucaagggcgaggucaucgccaagaacggcgacguccgcuccuaccgcauggacauggagaucaccaacaccgacggcacccccaucgaccccaccgaggacacccccggccccaucggcucccccgacuuccagggcauccucuucggcgucgccucccagcgcaacaagaacgagcagaaccccgccacccgcgcccacgaggccaacaucaacaccggcggcgaccaguacgcccccaagcucgcccaggucaaguucuucuccgagucccaggacuucgagguccaccagcccaccgucuucacccccgucggcgucgccggcgacaccucccaccccuuccgccaguggguccucccccgcuacggcggccaccucaccaacaacacccaccucgcccccgccgucgccccccucuuccccggcgagcagauccucuucuuccgcucccagauccccuccuccggcggccacgagcucggcuacauggacugccucgucccccaggaguggguccagcacuucuaccaggaggccgccaccgcccaguccgaggucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcauccaguga

SEQ ID NO: 14127 - RNA, 1623 nt, Artificial Sequence
  derived and/or modified sequence opt2 from VP1__Norovirus__AII73777
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcgccgucuga

SEQ ID NO: 14128 - RNA, 1611 nt, Artificial Sequence
  derived and/or modified sequence opt2 from VP1__Norovirus__AII73780
augaagauggccuccaacgacgccacccccuccgacgacggcgccgccggccucguccccgagaucaacuccgaggucauggcccucgagcccgucgccggcgccuccaucgccgcccccgucgucggccagcagaacaucaucgaccccuggauccgcaacaacuucguccaggcccccgccggcgaguucaccgucuccccccgcaacucccccggcgagcuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgccaucccccccuccuuccccuacgagaaccucucccccgcccagcucaccaugugcccccacgucaucgucgacguccgccagcucgagcccguccuccuccccaugcccgacauccgcaacgucuucuaccacuacaaccagaacaacucccccaagcuccgccucgucgccaugcucuacaccccccuccgcgccaacaacuccggcgacgacgucuucaccgucuccugccgcguccucacccgccccucccccgacuuccaguucaccuuccucgucccccccaccgucgaguccaagaccaagaacuucacccuccccguccuccgcgucuccgagaugaccaacucccgcuuccccgucguccucgaccagauguacaccucccgcaacgagaacaccaucguccagccccagaacggccgcugcaccaccgacggcgagcuccucggcaccaccauccuccaguccgucuccaucugcaacuucaagggcaccaugcaggccaagcucaacgaggagccccgcuaccagcuccagcucaccaaccucgacggcucccccaucgaccccaccgacgacaugcccgccccccucggcacccccgacuuccaggccguccucuacggcgucgccucccagcgcuccucccgcgacaacgccacccgcgcccacgacgcccagaucgacaccgccggcgacaccuucgcccccaagaucggccagguccgcuucaaguccuccuccaacgacuucgaccuccacgaccccaccaaguucacccccaucggcgucaacgucgacgaccagcaccccuuccgccaguggucccuccccaacuacggcggccaccucgcccucaacaaccaccucgcccccgccgucaccccccucuuccccggcgagcagauccucuucuuccgcuccuacauccccuccgccggcggccacaccgacggcgccauggacugccuccucccccaggagugggucgagcacuucuaccaggaggccgcccccucccaguccgacaucgcccucguccgcuucaucaaccccgacaccggccgcguccucuucgaggccaagcuccacaagcagggcuuccucaccaucgccgccuccggcgaccaccccaucgucaugcccaccaacggcuacuuccgcuucgaggccugggucaaccccuucuacacccucgcccccgucggcaccggcuccggccgccgccgcauccaguga

SEQ ID NO: 14129 - RNA, 1632 nt, Artificial Sequence
  derived and/or modified sequence opt2 from VP1__Norovirus__AII73783
augaugauggccuccaaggacgcccccaccaacauggacggcaccuccggcgccggccagcucguccccgaggccaacaccgccgagccccuccccaucaagcccgucgccggcgccgccaccgccgucgccaccgccggccaggucaacaugaucgaccccuggaucaugaacaacuucguccaggccccccagggcgaguucaccaucucccccaacaacacccccggcgacauccucuucgaccuccagcucggcccccaccucaaccccuuccucgcccaccucucccgcauguacaacggcugggucggcaacaugcagguccgcaucaugcucgccggcaacgccuucuccgccggcaagaucaucgucugcugcaucccccccggcuucuccucccaguccaucuccaucgcccaggccaccauguucccccacgucaucgccgacguccgcguccucgagcccaucgacgucccccucgacgacguccgcaacguccucuuccacaacaacgacaacccccagaccaugcgccuccucugcaugcucuacaccccccuccgcuccggcggcaccuccuccggcaccgaccccuucgucaucgccggccgcguccucaccugccccacccccgacuucuccuuccucuuccucgucccccccgacaucgagcagcgcaccaagcccuucuccguccccaacauccccaugaaccucauguccaacucccgcgucuccaugcucaucgacggcaugauggucuccaacgaccagaaccaggucccccaguuccagaacggccgcgucacccucgacggccagcuccagggcaccaccaccgucuccgccgccugcgucgcccgcaugcgcggccgcaucuucaacaacaacggcaacuacggcgucaaccucaccgagcucgacggcaaccccuaccacgccuucgacucccccgccccccucggcuuccccgacuucggcaacugcgaccuccacaugaccuucgucaagaucaaccccaacgagcucuccuccggcgaccccuccggcaaggucgucauccacuccuacgacgccaccuucgccccccaccucggcaccgucaagcucgagaacgacgacgagcucgcccgcuucgucggcaaggaggucguccucgagcucaccugggucuccaaccgcgagggcgccacccucaaccucugggccguccccaacuacggcuccucccucacccaggccucccagcucgccccccccaucuacccccccggcuucggcgaggccaucgucuacuucaccuccaccuuccccaccgucuccaaccccaagguccccugcacccucccccaggaguucgucucccacuucgucaacgagcaggcccccacccgcggcgacgccgcccuccuccacuacgucgaccccgacacccaccgcaaccucggcgaguucaagauguaccccgagggcuacaugaccugcguccccaacgccggcggcggcccccagacccuccccaucaacggcgucuucgucuucaucuccugggucucccgcuacuaccagcucaagcccgucggcaccgccggcgccgcccgccgccucggccuccgccgcuccuga

SEQ ID NO: 14130 - RNA, 1608 nt, Artificial Sequence
  derived and/or modified sequence opt2 from VP1__Norovirus__AII73786
augaagauggccuccuccgacgccgcccccuccaacgacggcgccgccggccucguccccgaggccaacaacgagaccauggcccucgagcccgucgccggcgccuccaucgccgccccccucaccggccagaacaacaucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggaggagaacgacguccacaucaaccagcccaccaaguucacccccgucggccucuucgaggacgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 14131 - RNA, 1623 nt, Artificial Sequence
  derived and/or modified sequence opt2 from VP1__Norovirus__AIS40019
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccccgcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcgccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14132 - RNA, 1623 nt, Artificial Sequence; identical to SEQ ID NO: 13903
  derived and/or modified sequence opt2 from VP1__Norovirus__AIV43147

SEQ ID NO: 14133 - RNA, 1623 nt, Artificial Sequence; identical to SEQ ID NO: 13907
  derived and/or modified sequence opt2 from VP1__Norovirus__AIV43148

SEQ ID NO: 14134 - RNA, 1623 nt, Artificial Sequence; identical to SEQ ID NO: 13907
  derived and/or modified sequence opt2 from VP1__Norovirus__AIV43149

SEQ ID NO: 14135 - RNA, 1623 nt, Artificial Sequence
  derived and/or modified sequence opt2 from VP1__Norovirus__AIV43150
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14136 - RNA, 1623 nt, Artificial Sequence
  derived and/or modified sequence opt2 from VP1__Norovirus__AIV43151
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14137 - RNA, 1623 nt, Artificial Sequence; identical to SEQ ID NO: 13903
  derived and/or modified sequence opt2 from VP1__Norovirus__AIV43152

SEQ ID NO: 14138 - RNA, 1623 nt, Artificial Sequence; identical to SEQ ID NO: 13903
  derived and/or modified sequence opt2 from VP1__Norovirus__AIV43153

SEQ ID NO: 14139 - RNA, 1623 nt, Artificial Sequence; identical to SEQ ID NO: 13903
  derived and/or modified sequence opt2 from VP1__Norovirus__AIV43154

SEQ ID NO: 14140 - RNA, 1623 nt, Artificial Sequence; identical to SEQ ID NO: 13855
  derived and/or modified sequence opt2 from VP1__Norovirus__AIV43155

SEQ ID NO: 14141 - RNA, 1623 nt, Artificial Sequence
  derived and/or modified sequence opt2 from VP1__Norovirus__AIV43156
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucgcccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccaccaagaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14142 - RNA, 1623 nt, Artificial Sequence
  derived and/or modified sequence opt2 from VP1__Norovirus__AIV43159
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucgcccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14143 - RNA, 1623 nt, Artificial Sequence
  derived and/or modified sequence opt2 from VP1__Norovirus__AIV43160
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucauccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14144 - RNA, 1623 nt, Artificial Sequence; identical to SEQ ID NO: 14143
  derived and/or modified sequence opt2 from VP1__Norovirus__AIV43161

SEQ ID NO: 14145 - RNA, 1623 nt, Artificial Sequence; identical to SEQ ID NO: 13903
  derived and/or modified sequence opt2 from VP1__Norovirus__AIV43162

SEQ ID NO: 14146 - RNA, 1623 nt, Artificial Sequence; identical to SEQ ID NO: 13903
  derived and/or modified sequence opt2 from VP1__Norovirus__AIV43163

SEQ ID NO: 14147 - RNA, 1623 nt, Artificial Sequence; identical to SEQ ID NO: 14143
  derived and/or modified sequence opt2 from VP1__Norovirus__AIV43164

SEQ ID NO: 14148 - RNA, 1623 nt, Artificial Sequence
  derived and/or modified sequence opt2 from VP1__Norovirus__AIV43165
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14149 - RNA, 1623 nt, Artificial Sequence
  derived and/or modified sequence opt2 from VP1__Norovirus__AIV43166
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14150 - RNA, 1623 nt, Artificial Sequence
  derived and/or modified sequence opt2 from VP1__Norovirus__AIV43167
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14151 - RNA, 1623 nt, Artificial Sequence
  derived and/or modified sequence opt2 from VP1__Norovirus__AIV43171
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14152 - RNA, 1623 nt, Artificial Sequence
  derived and/or modified sequence opt2 from VP1__Norovirus__AIV43172
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14153 - RNA, 1623 nt, Artificial Sequence
  derived and/or modified sequence opt2 from VP1__Norovirus__AIV43173
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcauccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14154 - RNA, 1623 nt, Artificial Sequence
  derived and/or modified sequence opt2 from VP1__Norovirus__AIV43174
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14155 - RNA, 1623 nt, Artificial Sequence; identical to SEQ ID NO: 14154
  derived and/or modified sequence opt2 from VP1__Norovirus__AIV43175

SEQ ID NO: 14156 - RNA, 1623 nt, Artificial Sequence; identical to SEQ ID NO: 13903
  derived and/or modified sequence opt2 from VP1__Norovirus__AIV43176

SEQ ID NO: 14157 - RNA, 1623 nt, Artificial Sequence; identical to SEQ ID NO: 14098
  derived and/or modified sequence opt2 from VP1__Norovirus__AIV43177

SEQ ID NO: 14158 - RNA, 1623 nt, Artificial Sequence; identical to SEQ ID NO: 14152
  derived and/or modified sequence opt2 from VP1__Norovirus__AIV43178

SEQ ID NO: 14159 - RNA, 1623 nt, Artificial Sequence
  derived and/or modified sequence opt2 from VP1__Norovirus__AIV43179
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggacauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14160 - RNA, 1623 nt, Artificial Sequence
  derived and/or modified sequence opt2 from VP1__Norovirus__AIY27747
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14161 - RNA, 1623 nt, Artificial Sequence; identical to SEQ ID NO: 14154
  derived and/or modified sequence opt2 from VP1__Norovirus__AJA71387

SEQ ID NO: 14162 - RNA, 1623 nt, Artificial Sequence
  derived and/or modified sequence opt2 from VP1__Norovirus__AJA71388
augaagauggccuccuccgacgccaaccccuccgacggcuccgccgccaaccucguccccgaggucaacaacgagguccucgcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14163 - RNA, 1623 nt, Artificial Sequence; identical to SEQ ID NO: 14152
  derived and/or modified sequence opt2 from VP1__Norovirus__AJA71389

SEQ ID NO: 14164 - RNA, 1623 nt, Artificial Sequence
  derived and/or modified sequence opt2 from VP1__Norovirus__AJA71390
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggccuccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14165 - RNA, 1623 nt, Artificial Sequence; identical to SEQ ID NO: 13903
  derived and/or modified sequence opt2 from VP1__Norovirus__AJA71392

SEQ ID NO: 14166 - RNA, 1623 nt, Artificial Sequence; identical to SEQ ID NO: 13907
  derived and/or modified sequence opt2 from VP1__Norovirus__AJA71393

SEQ ID NO: 14167 - RNA, 1623 nt, Artificial Sequence
  derived and/or modified sequence opt2 from VP1__Norovirus__AJA71394
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaucggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacucccgcgucaaccaguucuacacccucgcccccaugggcaacggcaccggccgccgccgcgcccucuga

SEQ ID NO: 14168 - RNA, 1623 nt, Artificial Sequence; identical to SEQ ID NO: 14098
  derived and/or modified sequence opt2 from VP1__Norovirus__AJA71395

SEQ ID NO: 14169 - RNA, 1623 nt, Artificial Sequence
  derived and/or modified sequence opt2 from VP1__Norovirus__AJA71396
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14170 - RNA, 1623 nt, Artificial Sequence
  derived and/or modified sequence opt2 from VP1__Norovirus__AJA71399
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgccgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14171 - RNA, 1623 nt, Artificial Sequence
  derived and/or modified sequence opt2 from VP1__Norovirus__AJA71400
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgagaccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14172 - RNA, 1623 nt, Artificial Sequence
  derived and/or modified sequence opt2 from VP1__Norovirus__AJA71401
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucggcaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14173 - RNA, 1623 nt, Artificial Sequence; identical to SEQ ID NO: 13907
  derived and/or modified sequence opt2 from VP1__Norovirus__AJA71402

SEQ ID NO: 14174 - RNA, 1623 nt, Artificial Sequence
  derived and/or modified sequence opt2 from VP1__Norovirus__AJA71403
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccaucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14175 - RNA, 1623 nt, Artificial Sequence; identical to SEQ ID NO: 14171
  derived and/or modified sequence opt2 from VP1__Norovirus__AJA71404

SEQ ID NO: 14176 - RNA, 1623 nt, Artificial Sequence
  derived and/or modified sequence opt2 from VP1__Norovirus__AJA71405
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcauccccgacuucgucggcaagauccagggcaugcucacccagaccacccgcaccgacggcuccacccgcggccacaaggccaccgucuacaccggcuccgucgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14177 - RNA, 1623 nt, Artificial Sequence
  derived and/or modified sequence opt2 from VP1__Norovirus__AJA71406
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14178 - RNA, 1623 nt, Artificial Sequence
  derived and/or modified sequence opt2 from VP1__Norovirus__AJA71407
augaagauggccuccuccgacgccacccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14179 - RNA, 1623 nt, Artificial Sequence; identical to SEQ ID NO: 14174
  derived and/or modified sequence opt2 from VP1__Norovirus__AJA71408

SEQ ID NO: 14180 - RNA, 1623 nt, Artificial Sequence; identical to SEQ ID NO: 14171
  derived and/or modified sequence opt2 from VP1__Norovirus__AJA71409

SEQ ID NO: 14181 - RNA, 1623 nt, Artificial Sequence
  derived and/or modified sequence opt2 from VP1__Norovirus__AJA71410
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14182 - RNA, 1623 nt, Artificial Sequence; identical to SEQ ID NO: 14098
  derived and/or modified sequence opt2 from VP1__Norovirus__AJA71411

SEQ ID NO: 14183 - RNA, 1623 nt, Artificial Sequence
  derived and/or modified sequence opt2 from VP1__Norovirus__AJA71412
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14184 - RNA, 1623 nt, Artificial Sequence; identical to SEQ ID NO: 13903
  derived and/or modified sequence opt2 from VP1__Norovirus__AJA71413

SEQ ID NO: 14185 - RNA, 1623 nt, Artificial Sequence; identical to SEQ ID NO: 13855
  derived and/or modified sequence opt2 from VP1__Norovirus__AJA71416

SEQ ID NO: 14186 - RNA, 1623 nt, Artificial Sequence
  derived and/or modified sequence opt2 from VP1__Norovirus__AJA71417
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucaccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14187 - RNA, 1623 nt, Artificial Sequence
  derived and/or modified sequence opt2 from VP1__Norovirus__AJA71418
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14188 - RNA, 1623 nt, Artificial Sequence; identical to SEQ ID NO: 14187
  derived and/or modified sequence opt2 from VP1__Norovirus__AJA71419

SEQ ID NO: 14189 - RNA, 1623 nt, Artificial Sequence; identical to SEQ ID NO: 13903
  derived and/or modified sequence opt2 from VP1__Norovirus__AJA71420

SEQ ID NO: 14190 - RNA, 1623 nt, Artificial Sequence; identical to SEQ ID NO: 14098
  derived and/or modified sequence opt2 from VP1__Norovirus__AJA71421

SEQ ID NO: 14191 - RNA, 1623 nt, Artificial Sequence; identical to SEQ ID NO: 14174
  derived and/or modified sequence opt2 from VP1__Norovirus__AJA71422

SEQ ID NO: 14192 - RNA, 1623 nt, Artificial Sequence
  derived and/or modified sequence opt2 from VP1__Norovirus__AJA71423
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaucggcggcgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14193 - RNA, 1623 nt, Artificial Sequence
  derived and/or modified sequence opt2 from VP1__Norovirus__AJA71424
augaagauggccuccuccgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgcaagcgcgcccucuga

SEQ ID NO: 14194 - RNA, 1623 nt, Artificial Sequence
  derived and/or modified sequence opt2 from VP1__Norovirus__AJA71425
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccgucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14195 - RNA, 1623 nt, Artificial Sequence
  derived and/or modified sequence opt2 from VP1__Norovirus__AJA71426
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccuccuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14196 - RNA, 1623 nt, Artificial Sequence
  derived and/or modified sequence opt2 from VP1__Norovirus__AJA71427
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggggcaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14197 - RNA, 1623 nt, Artificial Sequence; identical to SEQ ID NO: 14181
  derived and/or modified sequence opt2 from VP1__Norovirus__AJA71428

SEQ ID NO: 14198 - RNA, 1623 nt, Artificial Sequence
  derived and/or modified sequence opt2 from VP1__Norovirus__AJA71429
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagacccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgucaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcaccggccgccgccgcguccucuga

SEQ ID NO: 14199 - RNA, 1623 nt, Artificial Sequence
  derived and/or modified sequence opt2 from VP1__Norovirus__AJA71430
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgacgccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14200 - RNA, 1623 nt, Artificial Sequence
  derived and/or modified sequence opt2 from VP1__Norovirus__AJA71456
augaagauggccuccuccgacgccaaccccuccgacggcuccgccgccaaccucguccccgaggucaacaacgaggucauggcccucgagcccgucgucggcgccaccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcauccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14201 - RNA, 1623 nt, Artificial Sequence
  derived and/or modified sequence opt2 from VP1__Norovirus__AJA71457
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccuccauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14202 - RNA, 1623 nt, Artificial Sequence
  derived and/or modified sequence opt2 from VP1__Norovirus__AJA71458
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccgccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14203 - RNA, 1623 nt, Artificial Sequence
  derived and/or modified sequence opt2 from VP1__Norovirus__AJA71459
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgucgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14204 - RNA, 1623 nt, Artificial Sequence; identical to SEQ ID NO: 14174
  derived and/or modified sequence opt2 from VP1__Norovirus__AJA71460

SEQ ID NO: 14205 - RNA, 1623 nt, Artificial Sequence; identical to SEQ ID NO: 13903
  derived and/or modified sequence opt2 from VP1__Norovirus__AJA71461

SEQ ID NO: 14206 - RNA, 1623 nt, Artificial Sequence; identical to SEQ ID NO: 14177
  derived and/or modified sequence opt2 from VP1__Norovirus__AJA71462

SEQ ID NO: 14207 - RNA, 1623 nt, Artificial Sequence; identical to SEQ ID NO: 14187
  derived and/or modified sequence opt2 from VP1__Norovirus__AJA71463

SEQ ID NO: 14208 - RNA, 1623 nt, Artificial Sequence; identical to SEQ ID NO: 14181
  derived and/or modified sequence opt2 from VP1__Norovirus__AJA71464

SEQ ID NO: 14209 - RNA, 1623 nt, Artificial Sequence; identical to SEQ ID NO: 14181
  derived and/or modified sequence opt2 from VP1__Norovirus__AJA71465

SEQ ID NO: 14210 - RNA, 1623 nt, Artificial Sequence
  derived and/or modified sequence opt2 from VP1__Norovirus__AJA71466
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaaccucguccaggcccccggcggcgaguucaccgucuccccccgcaacgcccccggcgagauccucugguccgccccccucggccccgagcucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14211 - RNA, 1623 nt, Artificial Sequence
  derived and/or modified sequence opt2 from VP1__Norovirus__AJA71467
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacacccgcuucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14212 - RNA, 1623 nt, Artificial Sequence
  derived and/or modified sequence opt2 from VP1__Norovirus__AJA71470
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcauccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14213 - RNA, 1623 nt, Artificial Sequence
  derived and/or modified sequence opt2 from VP1__Norovirus__AJA71471
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgagcucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaaccgcgaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14214 - RNA, 1623 nt, Artificial Sequence
  derived and/or modified sequence opt2 from VP1__Norovirus__AJA71472
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgagcucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14215 - RNA, 1623 nt, Artificial Sequence
  derived and/or modified sequence opt2 from VP1__Norovirus__AJA71473
augaagauggccuccuccgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14216 - RNA, 1623 nt, Artificial Sequence
  derived and/or modified sequence opt2 from VP1__Norovirus__AJA71474
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacaccgaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14217 - RNA, 1623 nt, Artificial Sequence; identical to SEQ ID NO: 14098
  derived and/or modified sequence opt2 from VP1__Norovirus__AJA71475

SEQ ID NO: 14218 - RNA, 1623 nt, Artificial Sequence; identical to SEQ ID NO: 14177
  derived and/or modified sequence opt2 from VP1__Norovirus__AJA71476

SEQ ID NO: 14219 - RNA, 1623 nt, Artificial Sequence
  derived and/or modified sequence opt2 from VP1__Norovirus__AJF21974
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccgcgucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcauccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14220 - RNA, 1623 nt, Artificial Sequence
  derived and/or modified sequence opt2 from VP1__Norovirus__AJF21975
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14221 - RNA, 1623 nt, Artificial Sequence; identical to SEQ ID NO: 14152
  derived and/or modified sequence opt2 from VP1__Norovirus__AJF21976

SEQ ID NO: 14222 - RNA, 1623 nt, Artificial Sequence
  derived and/or modified sequence opt2 from VP1__Norovirus__AJF21977
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14223 - RNA, 1623 nt, Artificial Sequence
  derived and/or modified sequence opt2 from VP1__Norovirus__AJF21978
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacaccgaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14224 - RNA, 1623 nt, Artificial Sequence
  derived and/or modified sequence opt2 from VP1__Norovirus__AJF21979
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14225 - RNA, 1623 nt, Artificial Sequence
  derived and/or modified sequence opt2 from VP1__Norovirus__AJF21980
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14226 - RNA, 1623 nt, Artificial Sequence; identical to SEQ ID NO: 14212
  derived and/or modified sequence opt2 from VP1__Norovirus__AJF21981

SEQ ID NO: 14227 - RNA, 1623 nt, Artificial Sequence; identical to SEQ ID NO: 14181
  derived and/or modified sequence opt2 from VP1__Norovirus__AJF21982

SEQ ID NO: 14228 - RNA, 1623 nt, Artificial Sequence
  derived and/or modified sequence opt2 from VP1__Norovirus__AJF21983
augaagauggccuccuccgacgccaaccccuccgacggcuccgccgccucccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgagaccgacaccgaccgcgacuucgaggccaaccagaacaccaaguucacccccgucggcgucauccaggacggcggcaccacccaccgcaacgagccccagcaguggguccuccccuccuacuccggccgcaacgcccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14229 - RNA, 1623 nt, Artificial Sequence
  derived and/or modified sequence opt2 from VP1__Norovirus__AJF21984
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccaacuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgagaccgacaccaaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14230 - RNA, 1623 nt, Artificial Sequence
  derived and/or modified sequence opt2 from VP1__Norovirus__AKE37037
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccaugggcaccggcaacggccgccgccgcgcccaguga

SEQ ID NO: 14231 - RNA, 1632 nt, Artificial Sequence
  derived and/or modified sequence opt2 from VP1__Norovirus__AKM20815
augaugauggccuccaaggacgcccccaccaacauggacggcaccuccggcgccggccagcucguccccgaggccaacaccgccgagccccuccccaucaagcccgucgccggcgccgccaccgccgucgccaccgccggccaggucaacaugaucgaccccuggaucaugaacaacuucguccaggccccccagggcgaguucaccaucucccccaacaacacccccggcgacauccucuucgaccuccagcucggcccccaccucaaccccuuccucgcccaccucucccgcauguacaacggcugggucggcaacaugcagguccgcaucaugcucgccggcaacgccuucuccgccggcaagaucaucgucugcugcaucccccccggcuucuccucccaguccaucuccaucgcccaggccaccauguucccccacgucaucgccgacguccgcguccucgagcccaucgacgucccccucgacgacguccgcaacguccucuuccacaacaacgacaacccccagaccaugcgccuccucugcaugcucuacaccccccuccgcuccggcggcaccuccuccggcaccgaccccuucgucaucgccggccgcguccucaccugccccacccccgacuucuccuuccucuuccucgucccccccgacaucgagcagcgcaccaagcccuucuccguccccaacauccccaugaaccucauguccaacucccgcgucuccaugcucaucgacggcaugauggucuccaacgaccagaaccaggucccccaguuccagaacggccgcgucacccucgacggccagcuccagggcaccaccaccgucuccgccgccugcgucgcccgcaugcgcggccgcaucuucaacaacaacggcaacuacggcgucaaccucaccgagcucgacggcaaccccuaccacgccuucgacucccccgccccccucggcuuccccgacuucggcaacugcgaccuccacaugaccuucgucaagaucaaccccaacgagcucuccuccggcgaccccuccggcaaggucgucauccgcuccuacgacgccaccuucgccccccaccucggcaccgucaagcucgagaacgacgacgagcucgcccgcuucgucggcaaggaggucguccucgagcucaccugggucuccaaccgcgagggcgccacccucaaccucugggccguccccaacuacggcuccucccucacccaggccucccagcucgccccccccaucuacccccccggcuucggcgaggccaucgucuacuucaccuccaccuuccccaccgucuccaaccccaagguccccugcacccucccccaggaguucgucucccacuucgucaacgagcaggcccccacccgcggcgacgccgcccuccuccacuacgucgaccccgacacccaccgcaaccucggcgaguucaagauguaccccgagggcuacaugaccugcguccccaacgccggcggcggcccccagacccuccccaucaacggcgucuucgucuucaucuccugggucucccgcuacuaccagcucaagcccgucggcaccgccggcgccgcccgccgccucggccuccgccgcuccuga

SEQ ID NO: 14232 - RNA, 1623 nt, Artificial Sequence
  derived and/or modified sequence opt2 from vp1__Norovirus__AKM20818
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucuccuuccagacccaggaccgcgaccccucccaguccgucaccuucgccaccaacgacgccuccuucguccccuaccucggcuccgucuccccccacaacggcgagggcuuccaggccggcgacaucaucggcucccucggcuggaucuccgcccccuccgacaacucccaguucaacgucugggccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 14233 - RNA, 1623 nt, Artificial Sequence
  derived and/or modified sequence opt2 from VP1__Norovirus__ALD83748
augaagauggccuccaacgacgccgcccccuccaacgacggcgccaccggccucguccccgaggucaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaccaaccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucaccaucuccgagcucaccaacucccgcuuccccguccccgucgacucccucuucaccgcccagaacaacaaccucaacguccagugccagaacggccgcugcacccucgacggcgagcuccagggcaccacccagcuccagcccuccggcaucugcgccuuccgcggcaagaucaccgccgacguccgccccaaccacgacgaccgcuggcacaugcagcucaccaaccucaacggcacccccuucgaccccaccgaggacguccccgccccccucggcacccccgacuucaccggccuccucuucggcgucgccucccagcgcaacguccagcccaaccccaacaccacccgcgcccacgaggccgucaucuccaccaccuccucccaguucguccccaagcucggcuccaucaacuucggcuccaccuccgaggacuucaucgucggccagcccaccaaguucacccccgucggcaucaagaucgaggacggccacgccuucgaccaguggacccucccccgcuacuccggccaccucacccucaacaugaaccucgccccccccgucgcccccaacuuccccggcgagcagcuccucuucuuccgcuccaacguccccugcgccggcggcaucuccgacggcgucaucgacugccuccucccccaggaguggauccagcacuucuaccaggaguccgcccccucccaguccgacgucgcccucauccgcuacgucaaccccgacaccggccgcacccucuucgaggccaagcuccaccgcaccggcuacaucaccgucgcccacuccggcgacuacccccucgucguccccuccaacggcuacuuccgcuucgacuccugggucaaccaguucuacucccucgcccccaugggcaccggcaacggccgccgccgcguccaguga

SEQ ID NO: 14234 - RNA, 1623 nt, Artificial Sequence
  derived and/or modified sequence opt2 from VP1__Norovirus__ALF12528
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuccucccccaagcucggccgcguccaguucgccaccgacaccgacaacgacuucgucgccaaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucacccaggcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14235 - RNA, 1623 nt, Artificial Sequence
  derived and/or modified sequence opt2 from VP1__Norovirus__ALF12529
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccacuucuacacccucgcccccgucggcaacggcaccggccgccgccgcgcccucuga

SEQ ID NO: 14236 - RNA, 1623 nt, Artificial Sequence
  derived and/or modified sequence opt2 from VP1__Norovirus__ALF12530
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccaacaacgacuucgacgccaaccagaacaccaaguucacccccgucggcgucauccaggacggcgagaccgcccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggagcucgacugccucaucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14237 - RNA, 1623 nt, Artificial Sequence
  derived and/or modified sequence opt2 from VP1__Norovirus__ALF12531
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucgagacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacuccaaccagaacaccaaguucacccccgucggcgucauccaggacggcggcaccacccaccgcaacgagccccagcaguggguccuccccuccuacuccggccgcgacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcguccucuga

SEQ ID NO: 14238 - RNA, 1623 nt, Artificial Sequence
  derived and/or modified sequence opt2 from VP1__Norovirus__ALF12532
augaagauggccuccuccgacgccaaccccuccgacggcuccaccgccaaccucguccccgaggucaacaacgaggucauggcccucgagcccgucgucggcgccgccaucgccgcccccgucgccggccagcagaacgccaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcggcaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14239 - RNA, 1623 nt, Artificial Sequence
  derived and/or modified sequence opt2 from VP1__Norovirus__ALF12533
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaccuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacugguccuccuacgaccccaccgaggagauccccgccccccucggcacccccgacuucgucggcaagauccagggcguccucacccagaccacccgcaccgacggcuccacccgcggccacaaggccaccgucuucaccggcuccgccgacuucucccccaagcucggccgcguccaguucgccaccgacaccgacaacgacuucgucgccaaccagaacaccaaguucacccccgucggcgucauccaggacggcggcaccgcccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14240 - RNA, 1623 nt, Artificial Sequence
  derived and/or modified sequence opt2 from VP1__Norovirus__ALF12534
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuucucccucgcccccaugggcaacggcaccggccgccgccgcgcccucuga

SEQ ID NO: 14241 - RNA, 1623 nt, Artificial Sequence
  derived and/or modified sequence opt2 from VP1__Norovirus__ALF12535
augaagauggccuccuccgacgccaaccccuccgucggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccucgucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccacccagaacuggaacuccuacgaccccaccgaggagauccccgccccccucggcacccccgacuucgucggcaagauccagggcguccucacccagaccaccaagaccgacggcuccacccgcggccacaaggccaccgucuacaccggcuccgccgacuucgcccccaagcucggccgcguccaguucgccaccgacaccgacaacgacuucgaggccaaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14242 - RNA, 1623 nt, Artificial Sequence
  derived and/or modified sequence opt2 from VP1__Norovirus__ALF12536
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccacccagaacugguccuccuacgaccccaccgaggagauccccgccccccucggcacccccgacuucgucggcaagauccagggcguccucacccagaccaccaagaccgacggcuccacccgcggccacaaggccaccgucuacaccggcuccgccgacuucgcccccaagcucggccgcguccaguucgccaccgacaccgacaacgacuucgaggccaaccagaacaccaaguucacccccgucggcgucauccaggacggcaacaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14243 - RNA, 1623 nt, Artificial Sequence
  derived and/or modified sequence opt2 from VP1__Norovirus__ALF12537
augaagauggccuccuccgacgccaaccccuccgacggcuccaccgccaaccucgcccccgaggucaacaacgaggucauggcccucgagcccgucgucggcgccgccaucgccgcccccgucgccggccagaagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccgcccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcgcgaccucgucaucccccccaacggcuacuuccgcuucgacuccugggucaaccaguucuacucccucgcccccaugggcaacggcaccggccgccgccgcgcccucuga

SEQ ID NO: 14244 - RNA, 1623 nt, Artificial Sequence
  derived and/or modified sequence opt2 from VP1__Norovirus__ALF12538
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcuccaccgacggcguccuccucggcaccacccagcucucccccgucaacaucugcaccuuccgcggcgacgucacccacaucgccggcucccacaacuacaccaugaaccucgccucccagaacugguccuccuacgaccccaccgaggagauccccgccccccucggcacccccgacuucgucggcaagauccagggcguccucacccagaccacccgcuccgacggcuccacccgcggccacaaggccaccgucuacaccggcuccgccgacuucucccccaagcucggccgcguccaguucgccaccgacaccgacaacgacuucgucuccaaccagaacaccaaguucacccccgucggcgucauccaggacggcgacaccgcccaccgcaacgagccccagcaguggguccuccccuccuacuccggccgcaacauccacaacguccaccucgcccccgccgucgcccccaccuuccccggcgagcagcuccucuucuuccgcuccaccauccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccacuucuacacccucgcccccaugggcaacggcaccggccgccgccgcguccucuga

SEQ ID NO: 14245 - RNA, 1623 nt, Artificial Sequence
  derived and/or modified sequence opt2 from VP1__Norovirus__ALF12539
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccgcaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcuccaccgacggcguccuccucggcaccacccagcucucccccgucaacaucugcaccuuccgcggcgacgucacccacaucgccggcucccacaacuacaccaugaaccucgccucccagaacugguccuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccaacaacgacuucgaguccaaccagaacaccaaguucgcccccgucggcgucauccaggacggcggcaccgcccaccgcaacgagccccagcaguggguccuccccuccuacuccggccgcaacauccacaacguccaccucgcccccgccgucgcccccaccuuccccggcgagcagcuccucuucuuccgcuccaccauccccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14246 - RNA, 1623 nt, Artificial Sequence
  derived and/or modified sequence opt2 from VP1__Norovirus__ALF12541
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgucggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccaccgacuucacccccaagcucggccgcgcccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14247 - RNA, 1623 nt, Artificial Sequence
  derived and/or modified sequence opt2 from VP1__Norovirus__ALF12542
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14248 - RNA, 1623 nt, Artificial Sequence
  derived and/or modified sequence opt2 from VP1__Norovirus__ALF12543
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacugcgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14249 - RNA, 1623 nt, Artificial Sequence
  derived and/or modified sequence opt2 from VP1__Norovirus__ALF12546
augaagauggccuccuccgacgccaaccccuccgagggcuccaccgccucccucguccccgaggucaacaacgaggucauggcccucgagcccgucgccggcgccgccaucgccgcccccgucgccggccaggucaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgagcccaccaucaagcucgucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccuccuucgucguccagccccagaacggccgcugcaccaccgacggcguccuccucggcaccacccagcucucccccgucaacaucugcaccuuccgcggcgacgucacccacaucuccggcucccgcaaccacaccaugaaccucgccucccagaacuggaacuccuacgaccccaccgaggagauccccgccccccucggcacccccgacuucgucggcaagauccagggcguccucacccagaccacccgcuccgacggcuccacccgcggccacaaggccaccgucuacaccggcuccgccgacuucucccccaagcucggccgcauccaguucgccaccgacaccgacaacgacuucgagaccaaccagaacaccaaguucacccccgucggcgucauccaggacggcggcaccacccaccgcaacgagccccagcaguggguccuccccaccuacuccggccgcaacacccacaacguccaccucgcccccgccgucgcccccaccuuccccggcgagcagcuccucuucuuccgcuccaccaugcccggcugcuccggcuaccccgacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuucacccucgcccccaugggcaacggcaccggccgccgccgcgcccucuga

SEQ ID NO: 14250 - RNA, 1623 nt, Artificial Sequence
  derived and/or modified sequence opt2 from VP1__Norovirus__ALF12547
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcuccgcccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14251 - RNA, 1623 nt, Artificial Sequence
  derived and/or modified sequence opt2 from VP1__Norovirus__ALF12560
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacuccgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcuccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccaccgcgccaccgucuacaccggcuccgccgacuucucccccaagcucggccgcguccaguucgccaccgacaccgacaacgacuucgucgccaaccagaacaccaaguucacccccgucggcgucauccaggacggcgacaccgcccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14252 - RNA, 1623 nt, Artificial Sequence
  derived and/or modified sequence opt2 from VP1__Norovirus__ALF12562
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccaccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14253 - RNA, 1623 nt, Artificial Sequence
  derived and/or modified sequence opt2 from VP1__Norovirus__ALF12564
augaagauggccuccuccgacgccaacuccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccaccaagaccgacggcuccacccgcggccacaaggccaccgucuacaccggcuccgccgacuucgcccccaagcucggccgcguccaguucgccaccgacaccgacaacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgccaccuga

SEQ ID NO: 14254 - RNA, 1623 nt, Artificial Sequence
  derived and/or modified sequence opt2 from VP1__Norovirus__ALF12566
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcgacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcaucgucuga

SEQ ID NO: 14255 - RNA, 1623 nt, Artificial Sequence
  derived and/or modified sequence opt2 from VP1__Norovirus__ALF12569
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccccuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccuacggcuacuuccgcuucgacuccugggucaaccaguucuacacccucgcccccaugggcaacggcaccggccgccgccgcgcccucuga

SEQ ID NO: 14256 - RNA, 1623 nt, Artificial Sequence; identical to SEQ ID NO: 14230
  derived and/or modified sequence opt2 from VP1__Norovirus__ALQ28762

SEQ ID NO: 14257 - RNA, 1632 nt, Artificial Sequence
  derived and/or modified sequence opt2 from VP1__Norovirus__ALS03883
augaagauggccuccaacgacgccgcccccuccaacgacggcgccgccggccucguccccgagaucaacaacgagaccauggcccucgagcccgucgccggcggcgccaucgccgccccccucaccggccagaccaacuucaucgaccccuggauccgcggcaacuacguccaggcccccaacggcgaguucaccgucuccccccgcaacucccccggcgagauccuccucaaccucgagcucggccccgagcucaaccccuuccucucccaccucucccgcauguacaacggcuacgccggcggcaucgacguccaggucaucauggccggcaacgccuucaccgccggcaagaucaucuucgccgccauccccccccacuuccccgucgagaaccucucccccccccagaucaccauguucccccacaucaucgucgacguccgcacccucgagcccaucaacauccccguccccgacguccgcaacaacuucuuccacuacaaccagaacaacgagucccgcaugcgccucgucgccaugcucuacaccccccuccgcuccaacggcuccgccgaggacgucuucaccgucuccugccgcguccucaccaagcccuccgccgacuucgaguucaacuaccucgucccccccaccgucgagucccgcaccaagcccuucaccauccccauccucaccaucggcgagaugaccaacucccgcuuccccguccccaucgacaugcuccacaccucccccaccgagaacaucgucguccagccccagaacggccgcugcaccaucgacggcgagcuccucggcaccacccagcucaucaccuccaacaucugcuccuuccgcggcuccaucuccggccacgagggcaacgacgaccagcaccucuggcacuucaacaucaccaaccccaacggcacccccuucgaccccaccgaggacguccccgccccccucggcacccccgacuuccgcggccagcucuacggcgucaucucccagcgcgaccgcgagggcacccccuccgagaacaaccagaaggccaaccgcucccaccagggcgucaucuccaccaucucccccaaguucguccccaagcucggcuccgucaugaucggcaccuggaccaccgacgacaucaagaaccagcccuccaaguucacccccaucggccucaacgacgacgacaacuucaagcagugggagcuccccaacuacuccggcgcccucacccucaacaugggccucgcccccuccgucuuccccaccuaccccggcgagcagauccucuucuuccgcuccuaccucccccucaagggcggcuacggcucccccuucaucgacugccucgucccccaggagugggucgcccacuucuaccaggaguccgcccccgcccagaccgacgucgcccucauccgcuacgucaaccccgagaccggccgcguccucuucgaggccaagcuccaccgccagggcuucaucaccgucgccaaguccggcgacucccccaucaacguccccgccaacggcuacuuccgcuucgacuccugggucaaccaguucuacucccucgcccccaugggcaccggcaacggccgccgccgcauccaguga

SEQ ID NO: 14258 - RNA, 1617 nt, Artificial Sequence
  derived and/or modified sequence opt2 from VP1__Norovirus__ALT06546
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccagaacaacguccuccagguccagugccagaacggccgcugcacccucgacggcgagcuccagggcaccacccagcuccuccccuccggcaucugcgccuuccgcggccgcgucaccgccgagaccgaccaccgcgacaaguggcacaugcagcuccagaaccucaacggcaccaccuacgaccccaccgacgacguccccgccccccucggcacccccgacuucaagggcgucgucuucggcauggccucccagcgcaacgucggcaacgacgcccccggcuccacccgcgcccacgaggccgucaucuccaccuacuccccccaguucguccccaagcucggcuccgucaacuuccgcuccaacgacaacgacuuccagcuccagcccaccaaguucacccccgucggcaucaacgacgacggcgaccaccccuuccgccagugggagcuccccgacuacuccggcccccucacccucaacaugaaccucgccccccccgucgcccccaacuuccccggcgagcagcuccucuucuuccgcuccuucguccccugcuccggcggcuacaaccagggcaucgucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggcuacuuccgcuucgacuccugggucaaccaguucuacucccucgcccccaugggcaccggcaacggccgccgccgcgcccaguga

SEQ ID NO: 14259 - RNA, 1647 nt, Artificial Sequence
  derived and/or modified sequence opt2 from VP1__Norovirus__BAG30939
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgcccgccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuucaugggcguccucacccgcuccaccucccgcgccuccgaccaggccgacaccgccaccccccgccucuucaacuacuacuggcacauccagcucgacaaccccaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuuccaccagaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14260 - RNA, 1623 nt, Artificial Sequence; identical to SEQ ID NO: 13702
  derived and/or modified sequence opt2 from VP1__Norovirus__BAG70428

SEQ ID NO: 14261 - RNA, 1623 nt, Artificial Sequence; identical to SEQ ID NO: 13702
  derived and/or modified sequence opt2 from VP1__Norovirus__BAG70431

SEQ ID NO: 14262 - RNA, 1623 nt, Artificial Sequence
  derived and/or modified sequence opt2 from VP1__Norovirus__BAG70434
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14263 - RNA, 1623 nt, Artificial Sequence
  derived and/or modified sequence opt2 from VP1__Norovirus__BAG70437
augaagauggccuccaacgacgccaaccccuccgacggcuccaccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccaaggucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14264 - RNA, 1623 nt, Artificial Sequence
  derived and/or modified sequence opt2 from VP1__Norovirus__BAG70440
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14265 - RNA, 1623 nt, Artificial Sequence
  derived and/or modified sequence opt2 from VP1__Norovirus__BAG70446
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14266 - RNA, 1623 nt, Artificial Sequence
  derived and/or modified sequence opt2 from VP1__Norovirus__BAG70449
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14267 - RNA, 1623 nt, Artificial Sequence
  derived and/or modified sequence opt2 from VP1__Norovirus__BAG70452
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14268 - RNA, 1623 nt, Artificial Sequence; identical to SEQ ID NO: 13572
  derived and/or modified sequence opt2 from VP1__Norovirus__BAG70458

SEQ ID NO: 14269 - RNA, 1623 nt, Artificial Sequence; identical to SEQ ID NO: 13250
  derived and/or modified sequence opt2 from VP1__Norovirus__BAG70461

SEQ ID NO: 14270 - RNA, 1623 nt, Artificial Sequence; identical to SEQ ID NO: 13250
  derived and/or modified sequence opt2 from VP1__Norovirus__BAG70464

SEQ ID NO: 14271 - RNA, 1623 nt, Artificial Sequence; identical to SEQ ID NO: 13250
  derived and/or modified sequence opt2 from VP1__Norovirus__BAG70467

SEQ ID NO: 14272 - RNA, 1623 nt, Artificial Sequence; identical to SEQ ID NO: 13702
  derived and/or modified sequence opt2 from VP1__Norovirus__BAG70470

SEQ ID NO: 14273 - RNA, 1623 nt, Artificial Sequence; identical to SEQ ID NO: 13702
  derived and/or modified sequence opt2 from VP1__Norovirus__BAG70473

SEQ ID NO: 14274 - RNA, 1623 nt, Artificial Sequence
  derived and/or modified sequence opt2 from VP1__Norovirus__BAG70476
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagcuccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14275 - RNA, 1623 nt, Artificial Sequence
  derived and/or modified sequence opt2 from VP1__Norovirus__BAG70482
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgacggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14276 - RNA, 1623 nt, Artificial Sequence; identical to SEQ ID NO: 13250
  derived and/or modified sequence opt2 from VP1__Norovirus__BAG70485

SEQ ID NO: 14277 - RNA, 1623 nt, Artificial Sequence; identical to SEQ ID NO: 13250
  derived and/or modified sequence opt2 from VP1__Norovirus__BAG70488

SEQ ID NO: 14278 - RNA, 1623 nt, Artificial Sequence
  derived and/or modified sequence opt2 from VP1__Norovirus__BAG70491
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14279 - RNA, 1623 nt, Artificial Sequence
  derived and/or modified sequence opt2 from VP1__Norovirus__BAG70494
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccacuucuacacccucgcccccaugggcaacggcaccggccgccgccgcgcccucuga

SEQ ID NO: 14280 - RNA, 1623 nt, Artificial Sequence; identical to SEQ ID NO: 13572
  derived and/or modified sequence opt2 from VP1__Norovirus__BAG70497

SEQ ID NO: 14281 - RNA, 1623 nt, Artificial Sequence; identical to SEQ ID NO: 13742
  derived and/or modified sequence opt2 from VP1__Norovirus__BAG70503

SEQ ID NO: 14282 - RNA, 1623 nt, Artificial Sequence; identical to SEQ ID NO: 13572
  derived and/or modified sequence opt2 from VP1__Norovirus__BAG70506

SEQ ID NO: 14283 - RNA, 1623 nt, Artificial Sequence
  derived and/or modified sequence opt2 from VP1__Norovirus__BAG70509
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14284 - RNA, 1623 nt, Artificial Sequence
  derived and/or modified sequence opt2 from VP1__Norovirus__BAG70512
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccucuccuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccucaugcgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14285 - RNA, 1623 nt, Artificial Sequence
  derived and/or modified sequence opt2 from VP1__Norovirus__BAG70515
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14286 - RNA, 1623 nt, Artificial Sequence; identical to SEQ ID NO: 14285
  derived and/or modified sequence opt2 from VP1__Norovirus__BAG70518

SEQ ID NO: 14287 - RNA, 1623 nt, Artificial Sequence
  derived and/or modified sequence opt2 from VP1__Norovirus__BAG70521
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14288 - RNA, 1623 nt, Artificial Sequence
  derived and/or modified sequence opt2 from VP1__Norovirus__BAG70524
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcucaucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14289 - RNA, 1623 nt, Artificial Sequence
  derived and/or modified sequence opt2 from VP1__Norovirus__BAG70527
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacuccuacgaccccaccgaggagauccccgccccccucggcacccccgacuucgucggcaagauccagggccuccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14290 - RNA, 1623 nt, Artificial Sequence; identical to SEQ ID NO: 14285
  derived and/or modified sequence opt2 from VP1__Norovirus__BAG70530

SEQ ID NO: 14291 - RNA, 1623 nt, Artificial Sequence; identical to SEQ ID NO: 14285
  derived and/or modified sequence opt2 from VP1__Norovirus__BAG70533

SEQ ID NO: 14292 - RNA, 1623 nt, Artificial Sequence; identical to SEQ ID NO: 14285
  derived and/or modified sequence opt2 from VP1__Norovirus__BAG70536

SEQ ID NO: 14293 - RNA, 1623 nt, Artificial Sequence; identical to SEQ ID NO: 13851
  derived and/or modified sequence opt2 from VP1__Norovirus__BAI70518

SEQ ID NO: 14294 - RNA, 1623 nt, Artificial Sequence
  derived and/or modified sequence opt2 from VP1__Norovirus__BAJ13508
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacauggcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14295 - RNA, 1623 nt, Artificial Sequence
  derived and/or modified sequence opt2 from VP1__Norovirus__BAJ13513
augaagauggccuccuccgacgccaacccccccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgccacccacaucgccggcucccgcuccuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuuccagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14296 - RNA, 1623 nt, Artificial Sequence
  derived and/or modified sequence opt2 from VP1__Norovirus__BAJ13520
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcaacguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14297 - RNA, 1623 nt, Artificial Sequence
  derived and/or modified sequence opt2 from VP1__Norovirus__BAJ13534
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14298 - RNA, 1623 nt, Artificial Sequence
  derived and/or modified sequence opt2 from VP1__Norovirus__BAJ13537
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacaaccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14299 - RNA, 1623 nt, Artificial Sequence
  derived and/or modified sequence opt2 from VP1__Norovirus__BAJ13540
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgucggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14300 - RNA, 1623 nt, Artificial Sequence; identical to SEQ ID NO: 14262
  derived and/or modified sequence opt2 from VP1__Norovirus__BAJ13543

SEQ ID NO: 14301 - RNA, 1623 nt, Artificial Sequence; identical to SEQ ID NO: 14262
  derived and/or modified sequence opt2 from VP1__Norovirus__BAJ13549

SEQ ID NO: 14302 - RNA, 1623 nt, Artificial Sequence
  derived and/or modified sequence opt2 from VP1__Norovirus__BAJ13552
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14303 - RNA, 1623 nt, Artificial Sequence
  derived and/or modified sequence opt2 from VP1__Norovirus__BAJ13555
augaagauggccuccaacgaccccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14304 - RNA, 1623 nt, Artificial Sequence; identical to SEQ ID NO: 14302
  derived and/or modified sequence opt2 from VP1__Norovirus__BAJ13558

SEQ ID NO: 14305 - RNA, 1623 nt, Artificial Sequence; identical to SEQ ID NO: 13572
  derived and/or modified sequence opt2 from VP1__Norovirus__BAJ13561

SEQ ID NO: 14306 - RNA, 1623 nt, Artificial Sequence
  derived and/or modified sequence opt2 from VP1__Norovirus__BAJ13564
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaucaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14307 - RNA, 1623 nt, Artificial Sequence
  derived and/or modified sequence opt2 from VP1__Norovirus__BAJ13567
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14308 - RNA, 1623 nt, Artificial Sequence; identical to SEQ ID NO: 14302
  derived and/or modified sequence opt2 from VP1__Norovirus__BAJ13573

SEQ ID NO: 14309 - RNA, 1623 nt, Artificial Sequence
  derived and/or modified sequence opt2 from VP1__Norovirus__BAJ13576
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccccugguccgagccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14310 - RNA, 1623 nt, Artificial Sequence
  derived and/or modified sequence opt2 from VP1__Norovirus__BAJ13579
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14311 - RNA, 1623 nt, Artificial Sequence; identical to SEQ ID NO: 13702
  derived and/or modified sequence opt2 from VP1__Norovirus__BAJ13582

SEQ ID NO: 14312 - RNA, 1623 nt, Artificial Sequence; identical to SEQ ID NO: 13851
  derived and/or modified sequence opt2 from VP1__Norovirus__BAJ13585

SEQ ID NO: 14313 - RNA, 1623 nt, Artificial Sequence
  derived and/or modified sequence opt2 from VP1__Norovirus__BAJ13591
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcucuacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14314 - RNA, 1623 nt, Artificial Sequence
  derived and/or modified sequence opt2 from VP1__Norovirus__BAJ13594
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14315 - RNA, 1623 nt, Artificial Sequence; identical to SEQ ID NO: 14302
  derived and/or modified sequence opt2 from VP1__Norovirus__BAJ13597

SEQ ID NO: 14316 - RNA, 1623 nt, Artificial Sequence
  derived and/or modified sequence opt2 from VP1__Norovirus__BAJ13603
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14317 - RNA, 1623 nt, Artificial Sequence
  derived and/or modified sequence opt2 from VP1__Norovirus__BAJ13606
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccggcgacgacuuccagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14318 - RNA, 1623 nt, Artificial Sequence
  derived and/or modified sequence opt2 from VP1__Norovirus__BAJ13609
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaucaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucacccccaugggcaacggcaccggccgccgccgcgcccucuga

SEQ ID NO: 14319 - RNA, 1623 nt, Artificial Sequence
  derived and/or modified sequence opt2 from VP1__Norovirus__BAJ13612
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14320 - RNA, 1623 nt, Artificial Sequence
  derived and/or modified sequence opt2 from VP1__Norovirus__BAJ13615
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14321 - RNA, 1623 nt, Artificial Sequence
  derived and/or modified sequence opt2 from VP1__Norovirus__BAJ13618
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14322 - RNA, 1623 nt, Artificial Sequence; identical to SEQ ID NO: 13572
  derived and/or modified sequence opt2 from VP1__Norovirus__BAJ13621

SEQ ID NO: 14323 - RNA, 1623 nt, Artificial Sequence
  derived and/or modified sequence opt2 from VP1__Norovirus__BAJ13624
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgccguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14324 - RNA, 1623 nt, Artificial Sequence
  derived and/or modified sequence opt2 from VP1__Norovirus__BAJ13627
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14325 - RNA, 1623 nt, Artificial Sequence
  derived and/or modified sequence opt2 from VP1__Norovirus__BAJ13630
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14326 - RNA, 1623 nt, Artificial Sequence
  derived and/or modified sequence opt2 from VP1__Norovirus__BAJ13633
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacacccgcuucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucuccuga

SEQ ID NO: 14327 - RNA, 1623 nt, Artificial Sequence; identical to SEQ ID NO: 14302
  derived and/or modified sequence opt2 from VP1__Norovirus__BAJ13636

SEQ ID NO: 14328 - RNA, 1623 nt, Artificial Sequence
  derived and/or modified sequence opt2 from VP1__Norovirus__BAJ13639
augaagauggccuccaacgacgccaaccccuccgacggcuccgccgccaaccucguccaggaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaucaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14329 - RNA, 1623 nt, Artificial Sequence; identical to SEQ ID NO: 14302
  derived and/or modified sequence opt2 from VP1__Norovirus__BAJ13642

SEQ ID NO: 14330 - RNA, 1623 nt, Artificial Sequence
  derived and/or modified sequence opt2 from VP1__Norovirus__BAJ13648
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14331 - RNA, 1623 nt, Artificial Sequence
  derived and/or modified sequence opt2 from VP1__Norovirus__BAJ13651
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccuccgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccuccaucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccagaacgagccccagcaguggguccuccccggcuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14332 - RNA, 1623 nt, Artificial Sequence
  derived and/or modified sequence opt2 from VP1__Norovirus__BAJ13654
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccaucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcggcguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14333 - RNA, 1623 nt, Artificial Sequence
  derived and/or modified sequence opt2 from VP1__Norovirus__BAJ13657
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccucccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14334 - RNA, 1623 nt, Artificial Sequence
  derived and/or modified sequence opt2 from VP1__Norovirus__BAJ13660
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccccugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccgcuucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14335 - RNA, 1623 nt, Artificial Sequence
  derived and/or modified sequence opt2 from VP1__Norovirus__BAJ13663
augaagauggccuccaacgacgccaaccccuccgacggcuccgccgccaaccucguccccgaggucaacaacgagggcauggcccucgagcccgucgucggcgccgccaucgccgcccccgucgccggccagaccaacgucaucgaccccuggauccgcaacaacuucguccaggcccccggcggcgaguucaccgucuccccccgcaacgcccccuccgagauccucugguccgccucccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcaacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcuccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14336 - RNA, 1623 nt, Artificial Sequence
  derived and/or modified sequence opt2 from VP1__Norovirus__BAJ13666
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14337 - RNA, 1623 nt, Artificial Sequence
  derived and/or modified sequence opt2 from VP1__Norovirus__BAJ13669
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14338 - RNA, 1623 nt, Artificial Sequence
  derived and/or modified sequence opt2 from VP1__Norovirus__BAJ13672
augaagauggccuccaacgacgccaaccgcuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcuccgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14339 - RNA, 1623 nt, Artificial Sequence
  derived and/or modified sequence opt2 from VP1__Norovirus__BAJ13675
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14340 - RNA, 1623 nt, Artificial Sequence
  derived and/or modified sequence opt2 from VP1__Norovirus__BAJ13678
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14341 - RNA, 1623 nt, Artificial Sequence
  derived and/or modified sequence opt2 from VP1__Norovirus__BAJ13681
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccaggacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14342 - RNA, 1623 nt, Artificial Sequence
  derived and/or modified sequence opt2 from VP1__Norovirus__BAJ13684
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgucucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14343 - RNA, 1623 nt, Artificial Sequence
  derived and/or modified sequence opt2 from VP1__Norovirus__BAJ13687
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14344 - RNA, 1623 nt, Artificial Sequence
  derived and/or modified sequence opt2 from VP1__Norovirus__BAJ13690
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14345 - RNA, 1623 nt, Artificial Sequence
  derived and/or modified sequence opt2 from VP1__Norovirus__BAJ13693
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucgucaaggcccccggcggcgaguucaccgucuccccccgcaacucccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14346 - RNA, 1623 nt, Artificial Sequence
  derived and/or modified sequence opt2 from VP1__Norovirus__BAJ13696
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacacccgcuucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcguccucuga

SEQ ID NO: 14347 - RNA, 1623 nt, Artificial Sequence
  derived and/or modified sequence opt2 from VP1__Norovirus__BAJ13699
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccucaucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14348 - RNA, 1623 nt, Artificial Sequence
  derived and/or modified sequence opt2 from VP1__Norovirus__BAJ13702
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacgcccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14349 - RNA, 1623 nt, Artificial Sequence
  derived and/or modified sequence opt2 from VP1__Norovirus__BAJ13711
augaagauggccuccaacgacgccaaccccuccgacggcuccgccgccaaccucguccccgaggucaacaacgaggucauggcccucgagcccgucgucggcgccgccaucgccgcccccgucgccgcccagcagaacgucaucgaccccuggauccgcaacaacuucguccaggcccccggcggcgaguucaccgucuccccccgcaacgcccccuccgagauccucugguccgccccccucggccccgaccucaaccccuaccucucccacuucgcccgcauguacaacugcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14350 - RNA, 1623 nt, Artificial Sequence; identical to SEQ ID NO: 14314
  derived and/or modified sequence opt2 from VP1__Norovirus__BAJ13714

SEQ ID NO: 14351 - RNA, 1623 nt, Artificial Sequence
  derived and/or modified sequence opt2 from VP1__Norovirus__BAJ13717
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacgucgccggcucccgcaacuacaucaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14352 - RNA, 1623 nt, Artificial Sequence
  derived and/or modified sequence opt2 from VP1__Norovirus__BAJ13720
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacgucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14353 - RNA, 1623 nt, Artificial Sequence
  derived and/or modified sequence opt2 from VP1__Norovirus__BAJ13723
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccacccgcggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14354 - RNA, 1623 nt, Artificial Sequence
  derived and/or modified sequence opt2 from VP1__Norovirus__BAJ13726
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14355 - RNA, 1623 nt, Artificial Sequence; identical to SEQ ID NO: 14314
  derived and/or modified sequence opt2 from VP1__Norovirus__BAJ13729

SEQ ID NO: 14356 - RNA, 1623 nt, Artificial Sequence; identical to SEQ ID NO: 14265
  derived and/or modified sequence opt2 from VP1__Norovirus__BAJ13732

SEQ ID NO: 14357 - RNA, 1623 nt, Artificial Sequence; identical to SEQ ID NO: 13572
  derived and/or modified sequence opt2 from VP1__Norovirus__BAJ13738

SEQ ID NO: 14358 - RNA, 1623 nt, Artificial Sequence
  derived and/or modified sequence opt2 from VP1__Norovirus__BAJ13741
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcgcccucuga

SEQ ID NO: 14359 - RNA, 1623 nt, Artificial Sequence; identical to SEQ ID NO: 14302
  derived and/or modified sequence opt2 from VP1__Norovirus__BAJ13744

SEQ ID NO: 14360 - RNA, 1623 nt, Artificial Sequence; identical to SEQ ID NO: 13792
  derived and/or modified sequence opt2 from VP1__Norovirus__BAJ13747

SEQ ID NO: 14361 - RNA, 1623 nt, Artificial Sequence; identical to SEQ ID NO: 13851
  derived and/or modified sequence opt2 from VP1__Norovirus__BAJ13750

SEQ ID NO: 14362 - RNA, 1623 nt, Artificial Sequence; identical to SEQ ID NO: 13792
  derived and/or modified sequence opt2 from VP1__Norovirus__BAJ13753

SEQ ID NO: 14363 - RNA, 1623 nt, Artificial Sequence
  derived and/or modified sequence opt2 from VP1__Norovirus__BAJ13756
augaagauggccuccuccgacgccaacccccccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcuccuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuuccagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14364 - RNA, 1623 nt, Artificial Sequence
  derived and/or modified sequence opt2 from VP1__Norovirus__BAJ13759
augaagauggccuccaacgacgccaaccccuccgacggcuccgccgccucccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14365 - RNA, 1623 nt, Artificial Sequence; identical to SEQ ID NO: 13851
  derived and/or modified sequence opt2 from VP1__Norovirus__BAJ13762

SEQ ID NO: 14366 - RNA, 1623 nt, Artificial Sequence; identical to SEQ ID NO: 13851
  derived and/or modified sequence opt2 from VP1__Norovirus__BAJ13765

SEQ ID NO: 14367 - RNA, 1623 nt, Artificial Sequence; identical to SEQ ID NO: 14354
  derived and/or modified sequence opt2 from VP1__Norovirus__BAJ13768

SEQ ID NO: 14368 - RNA, 1623 nt, Artificial Sequence
  derived and/or modified sequence opt2 from VP1__Norovirus__BAJ13771
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccgcccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14369 - RNA, 1623 nt, Artificial Sequence; identical to SEQ ID NO: 14302
  derived and/or modified sequence opt2 from VP1__Norovirus__BAJ13774

SEQ ID NO: 14370 - RNA, 1623 nt, Artificial Sequence
  derived and/or modified sequence opt2 from VP1__Norovirus__BAJ13777
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14371 - RNA, 1623 nt, Artificial Sequence; identical to SEQ ID NO: 14302
  derived and/or modified sequence opt2 from VP1__Norovirus__BAJ13780

SEQ ID NO: 14372 - RNA, 1623 nt, Artificial Sequence; identical to SEQ ID NO: 14302
  derived and/or modified sequence opt2 from VP1__Norovirus__BAJ13783

SEQ ID NO: 14373 - RNA, 1623 nt, Artificial Sequence; identical to SEQ ID NO: 13851
  derived and/or modified sequence opt2 from VP1__Norovirus__BAJ13786

SEQ ID NO: 14374 - RNA, 1623 nt, Artificial Sequence
  derived and/or modified sequence opt2 from VP1__Norovirus__BAJ13792
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagaaccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14375 - RNA, 1623 nt, Artificial Sequence
  derived and/or modified sequence opt2 from VP1__Norovirus__BAJ13795
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccccugguccgccccccucggccccgaccucaaccccuaccucucccaccucgcccgcauguacaacggcuacgccggcggcuucgagguccaggucguccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagaaccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14376 - RNA, 1623 nt, Artificial Sequence
  derived and/or modified sequence opt2 from VP1__Norovirus__BAJ13801
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucguccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagaaccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14377 - RNA, 1623 nt, Artificial Sequence
  derived and/or modified sequence opt2 from VP1__Norovirus__BAJ13804
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14378 - RNA, 1623 nt, Artificial Sequence; identical to SEQ ID NO: 13851
  derived and/or modified sequence opt2 from VP1__Norovirus__BAJ13807

SEQ ID NO: 14379 - RNA, 1623 nt, Artificial Sequence; identical to SEQ ID NO: 14377
  derived and/or modified sequence opt2 from VP1__Norovirus__BAJ13810

SEQ ID NO: 14380 - RNA, 1623 nt, Artificial Sequence; identical to SEQ ID NO: 14377
  derived and/or modified sequence opt2 from VP1__Norovirus__BAJ13816

SEQ ID NO: 14381 - RNA, 1623 nt, Artificial Sequence
  derived and/or modified sequence opt2 from VP1__Norovirus__BAJ13819
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucauccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14382 - RNA, 1623 nt, Artificial Sequence; identical to SEQ ID NO: 14377
  derived and/or modified sequence opt2 from VP1__Norovirus__BAJ13822

SEQ ID NO: 14383 - RNA, 1623 nt, Artificial Sequence
  derived and/or modified sequence opt2 from VP1__Norovirus__BAJ13825
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucaccccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgaccucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14384 - RNA, 1623 nt, Artificial Sequence
  derived and/or modified sequence opt2 from VP1__Norovirus__BAJ13828
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcacucccucuacuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14385 - RNA, 1623 nt, Artificial Sequence; identical to SEQ ID NO: 13851
  derived and/or modified sequence opt2 from VP1__Norovirus__BAJ13831

SEQ ID NO: 14386 - RNA, 1623 nt, Artificial Sequence; identical to SEQ ID NO: 13572
  derived and/or modified sequence opt2 from VP1__Norovirus__BAJ13834

SEQ ID NO: 14387 - RNA, 1623 nt, Artificial Sequence; identical to SEQ ID NO: 13851
  derived and/or modified sequence opt2 from VP1__Norovirus__BAJ13837

SEQ ID NO: 14388 - RNA, 1623 nt, Artificial Sequence
  derived and/or modified sequence opt2 from VP1__Norovirus__BAJ13840
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaaggccgacggcuccacccgcggccacaaggccaccgucuacaccggcuccgccgucuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14389 - RNA, 1623 nt, Artificial Sequence; identical to SEQ ID NO: 13851
  derived and/or modified sequence opt2 from VP1__Norovirus__BAJ13843

SEQ ID NO: 14390 - RNA, 1623 nt, Artificial Sequence; identical to SEQ ID NO: 13851
  derived and/or modified sequence opt2 from VP1__Norovirus__BAJ13846

SEQ ID NO: 14391 - RNA, 1623 nt, Artificial Sequence; identical to SEQ ID NO: 13851
  derived and/or modified sequence opt2 from VP1__Norovirus__BAJ13849

SEQ ID NO: 14392 - RNA, 1623 nt, Artificial Sequence
  derived and/or modified sequence opt2 from VP1__Norovirus__BAJ13852
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucauccccuccaacggcuacuuccgcuucgacuccugggucaaccaguucuacacccucgcccccaugggcaacggcaccggccgccgccgcgcccucuga

SEQ ID NO: 14393 - RNA, 1623 nt, Artificial Sequence
  derived and/or modified sequence opt2 from VP1__Norovirus__BAJ13855
augaagauggccuccaacgacgccaaccccuccgacggcuccgccgccaaccucguccccgaggucaacaacgaggucauggcccucgaccccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucugccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14394 - RNA, 1623 nt, Artificial Sequence; identical to SEQ ID NO: 13715
  derived and/or modified sequence opt2 from VP1__Norovirus__BAJ13858

SEQ ID NO: 14395 - RNA, 1623 nt, Artificial Sequence
  derived and/or modified sequence opt2 from VP1__Norovirus__BAJ13861
augaagaugcgcuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccggcuccugccgcguccucacccgccccucccccgacuucgacuucaucuuccucgucccccccaccgucgagucccgcaccaagcccuucuccgucuccuucuucaccggcgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14396 - RNA, 1623 nt, Artificial Sequence; identical to SEQ ID NO: 13715
  derived and/or modified sequence opt2 from VP1__Norovirus__BAJ13864

SEQ ID NO: 14397 - RNA, 1623 nt, Artificial Sequence
  derived and/or modified sequence opt2 from VP1__Norovirus__BAJ13867
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacugcauccucgaccucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14398 - RNA, 1623 nt, Artificial Sequence
  derived and/or modified sequence opt2 from VP1__Norovirus__BAJ13873
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggucgucuucaccgucuccugccgcguccucacccgccccucccccgacuucgacuucaucugccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucauccccuccaacggcuacuuccgcuucgacuccugggucaaccaguucuacacccucgcccccaugggcaacggcaccggccgccgccgcgcccucuga

SEQ ID NO: 14399 - RNA, 1623 nt, Artificial Sequence
  derived and/or modified sequence opt2 from VP1__Norovirus__BAJ13876
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccgcccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14400 - RNA, 1623 nt, Artificial Sequence
  derived and/or modified sequence opt2 from VP1__Norovirus__BAJ13879
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccauggaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14401 - RNA, 1623 nt, Artificial Sequence; identical to SEQ ID NO: 13572
  derived and/or modified sequence opt2 from VP1__Norovirus__BAJ13882

SEQ ID NO: 14402 - RNA, 1623 nt, Artificial Sequence
  derived and/or modified sequence opt2 from VP1__Norovirus__BAJ13885
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14403 - RNA, 1623 nt, Artificial Sequence
  derived and/or modified sequence opt2 from VP1__Norovirus__BAJ13891
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgccucccgcaccaagcccuucuccguccccuccgucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccaccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14404 - RNA, 1623 nt, Artificial Sequence
  derived and/or modified sequence opt2 from VP1__Norovirus__BAJ13894
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccagaacgcccccuccgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14405 - RNA, 1623 nt, Artificial Sequence
  derived and/or modified sequence opt2 from VP1__Norovirus__BAJ13897
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccaccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14406 - RNA, 1623 nt, Artificial Sequence
  derived and/or modified sequence opt2 from VP1__Norovirus__BAJ13900
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14407 - RNA, 1623 nt, Artificial Sequence; identical to SEQ ID NO: 14399
  derived and/or modified sequence opt2 from VP1__Norovirus__BAJ13903

SEQ ID NO: 14408 - RNA, 1623 nt, Artificial Sequence; identical to SEQ ID NO: 14406
  derived and/or modified sequence opt2 from VP1__Norovirus__BAJ13906

SEQ ID NO: 14409 - RNA, 1623 nt, Artificial Sequence
  derived and/or modified sequence opt2 from VP1__Norovirus__BAJ13909
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14410 - RNA, 1623 nt, Artificial Sequence; identical to SEQ ID NO: 13572
  derived and/or modified sequence opt2 from VP1__Norovirus__BAJ13912

SEQ ID NO: 14411 - RNA, 1623 nt, Artificial Sequence; identical to SEQ ID NO: 14337
  derived and/or modified sequence opt2 from VP1__Norovirus__BAJ13918

SEQ ID NO: 14412 - RNA, 1623 nt, Artificial Sequence
  derived and/or modified sequence opt2 from VP1__Norovirus__BAJ13924
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14413 - RNA, 1623 nt, Artificial Sequence
  derived and/or modified sequence opt2 from VP1__Norovirus__BAJ13927
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcggcgcccccuucacccccaagcucggcuccgcccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14414 - RNA, 1623 nt, Artificial Sequence
  derived and/or modified sequence opt2 from VP1__Norovirus__BAJ13930
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucgaccccgaccucaaccccuaccucucccagcucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14415 - RNA, 1623 nt, Artificial Sequence; identical to SEQ ID NO: 13715
  derived and/or modified sequence opt2 from VP1__Norovirus__BAJ13933

SEQ ID NO: 14416 - RNA, 1623 nt, Artificial Sequence; identical to SEQ ID NO: 13572
  derived and/or modified sequence opt2 from VP1__Norovirus__BAJ13936

SEQ ID NO: 14417 - RNA, 1623 nt, Artificial Sequence; identical to SEQ ID NO: 13851
  derived and/or modified sequence opt2 from VP1__Norovirus__BAJ13939

SEQ ID NO: 14418 - RNA, 1623 nt, Artificial Sequence
  derived and/or modified sequence opt2 from VP1__Norovirus__BAJ13942
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14419 - RNA, 1623 nt, Artificial Sequence; identical to SEQ ID NO: 14377
  derived and/or modified sequence opt2 from VP1__Norovirus__BAJ13945

SEQ ID NO: 14420 - RNA, 1623 nt, Artificial Sequence
  derived and/or modified sequence opt2 from VP1__Norovirus__BAJ13948
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcaacaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14421 - RNA, 1623 nt, Artificial Sequence; identical to SEQ ID NO: 13715
  derived and/or modified sequence opt2 from VP1__Norovirus__BAJ13951

SEQ ID NO: 14422 - RNA, 1623 nt, Artificial Sequence
  derived and/or modified sequence opt2 from VP1__Norovirus__BAJ13954
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcaacaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14423 - RNA, 1623 nt, Artificial Sequence
  derived and/or modified sequence opt2 from VP1__Norovirus__BAJ13957
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgcccccuccggccccgaccucaaccccuaccucucccaccucgcccgcauguucaacgacuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14424 - RNA, 1623 nt, Artificial Sequence; identical to SEQ ID NO: 13851
  derived and/or modified sequence opt2 from VP1__Norovirus__BAJ13960

SEQ ID NO: 14425 - RNA, 1623 nt, Artificial Sequence; identical to SEQ ID NO: 13851
  derived and/or modified sequence opt2 from VP1__Norovirus__BAJ13963

SEQ ID NO: 14426 - RNA, 1623 nt, Artificial Sequence; identical to SEQ ID NO: 14337
  derived and/or modified sequence opt2 from VP1__Norovirus__BAJ13966

SEQ ID NO: 14427 - RNA, 1623 nt, Artificial Sequence; identical to SEQ ID NO: 13572
  derived and/or modified sequence opt2 from VP1__Norovirus__BAJ13969

SEQ ID NO: 14428 - RNA, 1623 nt, Artificial Sequence
  derived and/or modified sequence opt2 from VP1__Norovirus__BAJ13972
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccguccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14429 - RNA, 1623 nt, Artificial Sequence
  derived and/or modified sequence opt2 from VP1__Norovirus__BAJ13975
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgccgacuucacccccaagcucggcuccguccaguucgccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaacuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14430 - RNA, 1623 nt, Artificial Sequence
  derived and/or modified sequence opt2 from VP1__Norovirus__BAJ13978
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccacccccuucacccccaagcucggcuccguccaguucuccaccgacaccgagaacgacuucgagacccaccagaacaccaaguucacccccgucggcgucauccaggacggcuccaccauccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14431 - RNA, 1623 nt, Artificial Sequence; identical to SEQ ID NO: 13851
  derived and/or modified sequence opt2 from VP1__Norovirus__BAJ13981

SEQ ID NO: 14432 - RNA, 1623 nt, Artificial Sequence; identical to SEQ ID NO: 13572
  derived and/or modified sequence opt2 from VP1__Norovirus__BAJ13984

SEQ ID NO: 14433 - RNA, 1623 nt, Artificial Sequence; identical to SEQ ID NO: 13572
  derived and/or modified sequence opt2 from VP1__Norovirus__BAJ13987

SEQ ID NO: 14434 - RNA, 1623 nt, Artificial Sequence
  derived and/or modified sequence opt2 from VP1__Norovirus__BAJ13990
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14435 - RNA, 1623 nt, Artificial Sequence; identical to SEQ ID NO: 13572
  derived and/or modified sequence opt2 from VP1__Norovirus__BAJ13993

SEQ ID NO: 14436 - RNA, 1623 nt, Artificial Sequence; identical to SEQ ID NO: 14377
  derived and/or modified sequence opt2 from VP1__Norovirus__BAJ13996

SEQ ID NO: 14437 - RNA, 1623 nt, Artificial Sequence; identical to SEQ ID NO: 14314
  derived and/or modified sequence opt2 from VP1__Norovirus__BAJ13999

SEQ ID NO: 14438 - RNA, 1623 nt, Artificial Sequence; identical to SEQ ID NO: 14377
  derived and/or modified sequence opt2 from VP1__Norovirus__BAJ14002

SEQ ID NO: 14439 - RNA, 1623 nt, Artificial Sequence
  derived and/or modified sequence opt2 from VP1__Norovirus__BAJ14005
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccucauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagauccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14440 - RNA, 1623 nt, Artificial Sequence
  derived and/or modified sequence opt2 from VP1__Norovirus__BAJ14008
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgaggucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14441 - RNA, 1623 nt, Artificial Sequence
  derived and/or modified sequence opt2 from VP1__Norovirus__BAJ14011
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagauccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14442 - RNA, 1623 nt, Artificial Sequence; identical to SEQ ID NO: 13572
  derived and/or modified sequence opt2 from VP1__Norovirus__BAJ14014

SEQ ID NO: 14443 - RNA, 1623 nt, Artificial Sequence
  derived and/or modified sequence opt2 from VP1__Norovirus__BAK43269
auggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgccucuacaacggcuacgccggcggcauggagguccaggucaugcucgccggcaacgccuucaccgccggcaagcucgucuuccccgccguccccccccacuuccccaucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaucgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 14444 - RNA, 1623 nt, Artificial Sequence
  derived and/or modified sequence opt2 from VP1__Norovirus__BAK43272
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacacccagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagucccgcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14445 - RNA, 1647 nt, Artificial Sequence
  derived and/or modified sequence opt2 from VP1__Norovirus__BAK43275
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgccaaccucaacggcacccccuacgaccccgccgaggacauccccggcccccucggcacccccgacuuccgcggcaaggucuucggcgucgccugccagcgcaaccccgacugcaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14446 - RNA, 1623 nt, Artificial Sequence
  derived and/or modified sequence opt2 from VP1__Norovirus__BAK43278
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccuccuacgucaccgucgcccacaccggccagcacgaccucgucaucccccccaacggcuacuuccgcuucgacuccugggucaaccaguucuacacccucgcccccaugggcaacggcaccggccgccgccacgcccucuga

SEQ ID NO: 14447 - RNA, 1623 nt, Artificial Sequence
  derived and/or modified sequence opt2 from VP1__Norovirus__BAK43284
auggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucucccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuucaccgucuccaucgaccagauguacaccucccucaacgaggucaucuccguccagugccagaacggccgcugcacccucgacggcgagcuccgcggcaccacccagcuccaggucuccggcaucugcgccuucaagggcgaggucaccgcccacguccacgacaacgaccaccucuacaacgucaccaucaccaaccucaacggcucccccuucgaccccuccgaggacguccccgccccccucggcguccccgacuuccagggccgcgucuucggcaucaucucccagcgcgacaagcacaacucccccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacgucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 14448 - RNA, 1644 nt, Artificial Sequence
  derived and/or modified sequence opt2 from VP1__Norovirus__BAL14785
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucuccaccaccgacccccgcuacacccccaagcucggcuccauccucaugcgcuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaugguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 14449 - RNA, 1749 nt, Artificial Sequence
  derived and/or modified sequence opt2 from VP1__Norovirus__BAR88157
augaagauggccuccuccgacgccgccucccccuccuccgacggcgccgccaaccucguccccgagaucaacaacgaggucauggcccucgagcccgucgccggcgcccagcucgccgcccccgucgccgaccaguucaacgccaucgaccccuggauccgccagaacuucguccaggcccccgagggcgaguucaccgucuccccccgcaacgcccccggcgagauccuccucaaccucgagcucggcccccaccucaaccccuuccuccagcaccucgcccagauguacaacgccuacgccggcggcauggagguccaggucguccucgccggcaacgccuucaccgccggcaagaucaucuucgccgccauccccccccacuucccccccgagcgccucuccgccgcccaggccacccaguucccccacgucaucaucgacguccgccagcucgagcccaucguccucccccuccccgacguccgccacaaccucuuccacuucaaccagcagaacgacgagcgcaugcgccucgucgccuuccucuacaccccccuccgcgccaacuccggcuccggcgacgacgucuucaccgucuccugccgcguccucacccgccccucccccgacuucgaguucauguuccucgucccccccaccgucgagcgcaagaccgucgccuucucccucccccagcucaccgucggcgagauguccaacucccgcuggcccgcccgcaucaccaccaugaucgccgacccccaccucccccagguccuccgcauccagaacggccgcugcacccucgacggcacccucaugggcaccacccagcucaaccccaacgacaucugccgcguccgcggcuacuucuccaacucccgcccccaggucaugugcgagggcgaggacgacgcccucgaccaggccucccucggcgccgagcccauccgcgaccaggcccccggccuccgcacccaggcccgcuccaccgagcgcugguucgccgucaccgagcucaacggccaggccuacgaccccuucggcgaccagcccgccccccucggcguccccgacuucgaggcccgcaucgucggcgcccucguccgccuccccggcaccaaccccaccuccaacucccgcuucgaggacgccuggaucgacaccaacaaccagaccaccuacgcccccgccgccggcauggucgccaucaccaccuccgacgacuccuccuccaacuacgccaacgaccaggucugcgaguuccucccccucggcgucgacaucaccaacuccacccccuacaacgaguucgaccuccccuccuacggcggcuccgccuccuccggcaaccgcaaccucgcccccaccgucgcccccaccuuccccggcgagaucguccuccucuucggcuccaacaugcccguccagaaccgcuccgccggcaccuccaacaaggagauccgcugccuccuccccaacgaguacauccagcaccucuacgacacccaggcccccucccucuccgacgucgcccucguccgcuacaucaaccccgacaccggccgcguccucuucgaggccaagcuccaccgcgacggcuucaugaccgucaacgccuccgccaccaccguccuccccgucgacggccacuuccgcuucgacuccugggucaaccaguucuacgcccucucccccgucggcaacgccuccggccgccgcggccgcaaccgccgcgucgacuga

SEQ ID NO: 14450 - RNA, 1623 nt, Artificial Sequence; identical to SEQ ID NO: 13851
  derived and/or modified sequence opt2 from VP1__Norovirus__BAS29993

SEQ ID NO: 14451 - RNA, 1623 nt, Artificial Sequence
  derived and/or modified sequence opt2 from VP1__Norovirus__BAS29996
augaagauggccuccaacgacgccacccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14452 - RNA, 1623 nt, Artificial Sequence
  derived and/or modified sequence opt2 from VP1__Norovirus__BAS29999
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgaggucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14453 - RNA, 1623 nt, Artificial Sequence
  derived and/or modified sequence opt2 from VP1__Norovirus__BAS30005
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14454 - RNA, 1623 nt, Artificial Sequence
  derived and/or modified sequence opt2 from VP1__Norovirus__BAS30008
augaagauggccuccaacgacgccaaccccuccgacggcuccgccgccaaccucguccccgaggucaacaacgaggucauggcccucgagcccgucgucggcgccgccaucgccgcccccgucgccggccagaccaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcuccaccacccaccgcaacgagccccagcaguggguccuccccuccuacuccggcggcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14455 - RNA, 1623 nt, Artificial Sequence; identical to SEQ ID NO: 14302
  derived and/or modified sequence opt2 from VP1__Norovirus__BAS30011

SEQ ID NO: 14456 - RNA, 1623 nt, Artificial Sequence
  derived and/or modified sequence opt2 from VP1__Norovirus__BAS30014
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaucuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14457 - RNA, 1623 nt, Artificial Sequence
  derived and/or modified sequence opt2 from VP1__Norovirus__BAS30017
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14458 - RNA, 1623 nt, Artificial Sequence
  derived and/or modified sequence opt2 from VP1__Norovirus__BAS30023
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14459 - RNA, 1623 nt, Artificial Sequence; identical to SEQ ID NO: 14337
  derived and/or modified sequence opt2 from VP1__Norovirus__BAS30026

SEQ ID NO: 14460 - RNA, 1623 nt, Artificial Sequence
  derived and/or modified sequence opt2 from VP1__Norovirus__BAS30029
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14461 - RNA, 1623 nt, Artificial Sequence
  derived and/or modified sequence opt2 from VP1__Norovirus__BAS30035
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14462 - RNA, 1623 nt, Artificial Sequence; identical to SEQ ID NO: 14461
  derived and/or modified sequence opt2 from VP1__Norovirus__BAS30038

SEQ ID NO: 14463 - RNA, 1623 nt, Artificial Sequence; identical to SEQ ID NO: 14458
  derived and/or modified sequence opt2 from VP1__Norovirus__BAS30041

SEQ ID NO: 14464 - RNA, 1623 nt, Artificial Sequence
  derived and/or modified sequence opt2 from VP1__Norovirus__BAS30044
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgagccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14465 - RNA, 1623 nt, Artificial Sequence; identical to SEQ ID NO: 14456
  derived and/or modified sequence opt2 from VP1__Norovirus__BAS30047

SEQ ID NO: 14466 - RNA, 1623 nt, Artificial Sequence; identical to SEQ ID NO: 13851
  derived and/or modified sequence opt2 from VP1__Norovirus__BAS30050

SEQ ID NO: 14467 - RNA, 1623 nt, Artificial Sequence
  derived and/or modified sequence opt2 from VP1__Norovirus__BAS30053
augaagauggccuccaacgacgccacccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucaacaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14468 - RNA, 1623 nt, Artificial Sequence; identical to SEQ ID NO: 14458
  derived and/or modified sequence opt2 from VP1__Norovirus__BAS30056

SEQ ID NO: 14469 - RNA, 1623 nt, Artificial Sequence
  derived and/or modified sequence opt2 from VP1__Norovirus__BAS30059
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccaggacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14470 - RNA, 1623 nt, Artificial Sequence; identical to SEQ ID NO: 14377
  derived and/or modified sequence opt2 from VP1__Norovirus__BAS30062

SEQ ID NO: 14471 - RNA, 1623 nt, Artificial Sequence
  derived and/or modified sequence opt2 from VP1__Norovirus__BAS30065
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgucgucaagaccacccucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14472 - RNA, 1623 nt, Artificial Sequence
  derived and/or modified sequence opt2 from VP1__Norovirus__BAS30068
augaagauggccuccaacgacgccaccgccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14473 - RNA, 1623 nt, Artificial Sequence; identical to SEQ ID NO: 14458
  derived and/or modified sequence opt2 from VP1__Norovirus__BAS30071

SEQ ID NO: 14474 - RNA, 1623 nt, Artificial Sequence; identical to SEQ ID NO: 14458
  derived and/or modified sequence opt2 from VP1__Norovirus__BAS30074

SEQ ID NO: 14475 - RNA, 1623 nt, Artificial Sequence
  derived and/or modified sequence opt2 from VP1__Norovirus__BAS30077
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccgcccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14476 - RNA, 1623 nt, Artificial Sequence
  derived and/or modified sequence opt2 from VP1__Norovirus__BAS30080
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggccagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14477 - RNA, 1623 nt, Artificial Sequence; identical to SEQ ID NO: 13851
  derived and/or modified sequence opt2 from VP1__Norovirus__BAS30083

SEQ ID NO: 14478 - RNA, 1623 nt, Artificial Sequence
  derived and/or modified sequence opt2 from VP1__Norovirus__BAS30086
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccaacucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14479 - RNA, 1623 nt, Artificial Sequence
  derived and/or modified sequence opt2 from VP1__Norovirus__BAS30089
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucuccaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccgcccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14480 - RNA, 1623 nt, Artificial Sequence
  derived and/or modified sequence opt2 from VP1__Norovirus__BAS30092
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccuccucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14481 - RNA, 1623 nt, Artificial Sequence
  derived and/or modified sequence opt2 from VP1__Norovirus__BAS30095
augaagauggccuccaacgacgccaaccccuucgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccgccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14482 - RNA, 1623 nt, Artificial Sequence
  derived and/or modified sequence opt2 from VP1__Norovirus__BAS30098
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucaucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14483 - RNA, 1623 nt, Artificial Sequence
  derived and/or modified sequence opt2 from VP1__Norovirus__BAS30101
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccgcccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14484 - RNA, 1623 nt, Artificial Sequence
  derived and/or modified sequence opt2 from VP1__Norovirus__BAS30104
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacgccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14485 - RNA, 1623 nt, Artificial Sequence
  derived and/or modified sequence opt2 from VP1__Norovirus__BAS30107
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14486 - RNA, 1623 nt, Artificial Sequence; identical to SEQ ID NO: 14458
  derived and/or modified sequence opt2 from VP1__Norovirus__BAS30110

SEQ ID NO: 14487 - RNA, 1623 nt, Artificial Sequence; identical to SEQ ID NO: 13851
  derived and/or modified sequence opt2 from VP1__Norovirus__BAS30113

SEQ ID NO: 14488 - RNA, 1623 nt, Artificial Sequence
  derived and/or modified sequence opt2 from VP1__Norovirus__BAS30116
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccgcuucuccaccgacaccgagaacgacuucgagauccaccagaacaccaaguucacccccgucggcgucauccaggacggcuccaccacccaccgcaacgagccccagcaguggguccuccccuccuacuccggccgcgacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14489 - RNA, 1623 nt, Artificial Sequence; identical to SEQ ID NO: 14458
  derived and/or modified sequence opt2 from VP1__Norovirus__BAS30119

SEQ ID NO: 14490 - RNA, 1623 nt, Artificial Sequence
  derived and/or modified sequence opt2 from VP1__Norovirus__BAS30125
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccgcuucuccaccgacaccgagaacgacuucgagauccaccagaacaccaaguucacccccgucggcgucauccaggacggcuccaccacccaccgcaacgagccccagcaguggguccuccccuccuacuccggccgcgacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcguccucuga

SEQ ID NO: 14491 - RNA, 1623 nt, Artificial Sequence; identical to SEQ ID NO: 13851
  derived and/or modified sequence opt2 from VP1__Norovirus__BAS30128

SEQ ID NO: 14492 - RNA, 1623 nt, Artificial Sequence
  derived and/or modified sequence opt2 from VP1__Norovirus__BAS30134
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14493 - RNA, 1623 nt, Artificial Sequence; identical to SEQ ID NO: 13851
  derived and/or modified sequence opt2 from VP1__Norovirus__BAS30137

SEQ ID NO: 14494 - RNA, 1623 nt, Artificial Sequence; identical to SEQ ID NO: 13851
  derived and/or modified sequence opt2 from VP1__Norovirus__BAS30140

SEQ ID NO: 14495 - RNA, 1623 nt, Artificial Sequence
  derived and/or modified sequence opt2 from VP1__Norovirus__BAS30146
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugucccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14496 - RNA, 1623 nt, Artificial Sequence
  derived and/or modified sequence opt2 from VP1__Norovirus__BAS30149
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14497 - RNA, 1623 nt, Artificial Sequence; identical to SEQ ID NO: 13851
  derived and/or modified sequence opt2 from VP1__Norovirus__BAS30152

SEQ ID NO: 14498 - RNA, 1623 nt, Artificial Sequence
  derived and/or modified sequence opt2 from VP1__Norovirus__BAS30155
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuucaagggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccagaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14499 - RNA, 1623 nt, Artificial Sequence
  derived and/or modified sequence opt2 from VP1__Norovirus__BAS30158
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccagcucaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugucccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14500 - RNA, 1623 nt, Artificial Sequence
  derived and/or modified sequence opt2 from VP1__Norovirus__BAS30164
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaucgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugucccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14501 - RNA, 1623 nt, Artificial Sequence; identical to SEQ ID NO: 14496
  derived and/or modified sequence opt2 from VP1__Norovirus__BAS30167

SEQ ID NO: 14502 - RNA, 1623 nt, Artificial Sequence; identical to SEQ ID NO: 13851
  derived and/or modified sequence opt2 from VP1__Norovirus__BAS30170

SEQ ID NO: 14503 - RNA, 1623 nt, Artificial Sequence
  derived and/or modified sequence opt2 from VP1__Norovirus__BAS30173
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccaguacgaccucgucaucccccccaacggcuacuuccgcuucgacuccugggucaaccaguucuacacccucgcccccaugggcaacggcaccggccgccgccgcgcccucuga

SEQ ID NO: 14504 - RNA, 1623 nt, Artificial Sequence
  derived and/or modified sequence opt2 from VP1__Norovirus__BAS30176
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagacccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14505 - RNA, 1623 nt, Artificial Sequence
  derived and/or modified sequence opt2 from VP1__Norovirus__BAS30179
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggccuccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14506 - RNA, 1623 nt, Artificial Sequence
  derived and/or modified sequence opt2 from VP1__Norovirus__BAS30182
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14507 - RNA, 1623 nt, Artificial Sequence
  derived and/or modified sequence opt2 from VP1__Norovirus__BAS30185
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14508 - RNA, 1623 nt, Artificial Sequence
  derived and/or modified sequence opt2 from VP1__Norovirus__BAS30188
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccacgacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14509 - RNA, 1623 nt, Artificial Sequence; identical to SEQ ID NO: 14461
  derived and/or modified sequence opt2 from VP1__Norovirus__BAS30191

SEQ ID NO: 14510 - RNA, 1623 nt, Artificial Sequence; identical to SEQ ID NO: 14461
  derived and/or modified sequence opt2 from VP1__Norovirus__BAS30194

SEQ ID NO: 14511 - RNA, 1623 nt, Artificial Sequence; identical to SEQ ID NO: 14461
  derived and/or modified sequence opt2 from VP1__Norovirus__BAS30197

SEQ ID NO: 14512 - RNA, 1623 nt, Artificial Sequence; identical to SEQ ID NO: 14461
  derived and/or modified sequence opt2 from VP1__Norovirus__BAS30200

SEQ ID NO: 14513 - RNA, 1623 nt, Artificial Sequence; identical to SEQ ID NO: 14461
  derived and/or modified sequence opt2 from VP1__Norovirus__BAS30203

SEQ ID NO: 14514 - RNA, 1623 nt, Artificial Sequence; identical to SEQ ID NO: 14461
  derived and/or modified sequence opt2 from VP1__Norovirus__BAS30206

SEQ ID NO: 14515 - RNA, 1623 nt, Artificial Sequence
  derived and/or modified sequence opt2 from VP1__Norovirus__BAS30209
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14516 - RNA, 1623 nt, Artificial Sequence
  derived and/or modified sequence opt2 from VP1__Norovirus__BAS30212
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14517 - RNA, 1623 nt, Artificial Sequence
  derived and/or modified sequence opt2 from VP1__Norovirus__BAS30215
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14518 - RNA, 1623 nt, Artificial Sequence; identical to SEQ ID NO: 14517
  derived and/or modified sequence opt2 from VP1__Norovirus__BAS30218

SEQ ID NO: 14519 - RNA, 1623 nt, Artificial Sequence
  derived and/or modified sequence opt2 from VP1__Norovirus__BAS30221
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagguccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14520 - RNA, 1623 nt, Artificial Sequence
  derived and/or modified sequence opt2 from VP1__Norovirus__BAS30224
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14521 - RNA, 1623 nt, Artificial Sequence
  derived and/or modified sequence opt2 from VP1__Norovirus__BAS30227
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcgccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccccaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14522 - RNA, 1623 nt, Artificial Sequence
  derived and/or modified sequence opt2 from VP1__Norovirus__BAS30230
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccuccucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccccaacguccaccucgcccccgccgucgcccccgccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14523 - RNA, 1623 nt, Artificial Sequence; identical to SEQ ID NO: 13851
  derived and/or modified sequence opt2 from VP1__Norovirus__BAS30233

SEQ ID NO: 14524 - RNA, 1623 nt, Artificial Sequence; identical to SEQ ID NO: 14517
  derived and/or modified sequence opt2 from VP1__Norovirus__BAS30236

SEQ ID NO: 14525 - RNA, 1623 nt, Artificial Sequence; identical to SEQ ID NO: 14517
  derived and/or modified sequence opt2 from VP1__Norovirus__BAS30239

SEQ ID NO: 14526 - RNA, 1623 nt, Artificial Sequence
  derived and/or modified sequence opt2 from VP1__Norovirus__BAS30242
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcgacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14527 - RNA, 1620 nt, Artificial Sequence
  derived and/or modified sequence opt2 from VP1__Norovirus__BAS30245
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccaucccccccaacuuccccaccgagggccucucccccucccaggucaccauguucccccacaucgucgucgacguccgccagcucgagcccguccucaucccccuccccgacguccgcaacaacuucuaccacuacaaccagaccaaggaguccaccaucaagcucgucgccaugcucuacaccccccuccgcgccaacaacgccggcgacgacgucuucaccgucuccugccgcguccucacccgccccucccccgacuucgacuucaucuuccucgucccccccuccgucgagucccgcaccaagcccuucaccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccgcgucuccaccacccacgucuacgagaugaaccucgccucccagaacuggaacaacuacgaccccaccgaggagguccccgccccccucggcacccccgacuucgucggcaagauccagggcguccucacccagaccacccgcaccgacggcuccacccgcgcccacaaggccaccgucuccaccggcgccgccgacuucacccccaagcucggcuccauccgcuucgagaccaccaccaaccgcgaccucgagacccaccagaacaccaaguucacccccgucggcgucauccaggacggcgacaaccaccagaacgagccccagcaguggcgccuccccggcuacgccggccgcgacgcccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuaccucaccgucgcccacaccggccccuacgaccucgucaucccccccaacggcuacuuccgcuucgacuccugggucaaccaguucuacacccucgcccccaugggcaacggcaccggccgccgccgcgcccucuga

SEQ ID NO: 14528 - RNA, 1623 nt, Artificial Sequence
  derived and/or modified sequence opt2 from VP1__Norovirus__BAS30248
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaucgucuacaccggcuccgccgacuucgcccccaagcucggccgcguccaguucgccaccgacaccgacaacgacuucggcgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14529 - RNA, 1623 nt, Artificial Sequence; identical to SEQ ID NO: 13792
  derived and/or modified sequence opt2 from VP1__Norovirus__BAS30251

SEQ ID NO: 14530 - RNA, 1626 nt, Artificial Sequence
  derived and/or modified sequence opt2 from VP1__Norovirus__BAS30254
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacuccaaggucucccccaucccccucaagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14531 - RNA, 1623 nt, Artificial Sequence; identical to SEQ ID NO: 13815
  derived and/or modified sequence opt2 from VP1__Norovirus__BAS30257

SEQ ID NO: 14532 - RNA, 1623 nt, Artificial Sequence; identical to SEQ ID NO: 13292
  derived and/or modified sequence opt2 from VP1__Norovirus__BAS30260

SEQ ID NO: 14533 - RNA, 1623 nt, Artificial Sequence
  derived and/or modified sequence opt2 from VP1__Norovirus__BAS30263
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgaguccgagaccaagcccuucuucuuccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14534 - RNA, 1623 nt, Artificial Sequence; identical to SEQ ID NO: 13815
  derived and/or modified sequence opt2 from VP1__Norovirus__BAS30266

SEQ ID NO: 14535 - RNA, 1623 nt, Artificial Sequence; identical to SEQ ID NO: 13815
  derived and/or modified sequence opt2 from VP1__Norovirus__BAS30269

SEQ ID NO: 14536 - RNA, 1623 nt, Artificial Sequence; identical to SEQ ID NO: 13815
  derived and/or modified sequence opt2 from VP1__Norovirus__BAS30272

SEQ ID NO: 14537 - RNA, 1623 nt, Artificial Sequence
  derived and/or modified sequence opt2 from VP1__Norovirus__BAS30275
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucuucccccucgcccgcaaggucaagggcuacgccggcggcuucgagguccaggucauccucgccggcaaggccuuccccgccggcaagaucaucuucgccgccuccccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgccgcgacggcuccacccgcggccacaaggccaccgucuacaccggcuccgccgacuucucccccaagcucggccgcguccaguucgccaccgacaccgacaacgacuucgacacccaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14538 - RNA, 1623 nt, Artificial Sequence; identical to SEQ ID NO: 13815
  derived and/or modified sequence opt2 from VP1__Norovirus__BAS30278

SEQ ID NO: 14539 - RNA, 1623 nt, Artificial Sequence; identical to SEQ ID NO: 13288
  derived and/or modified sequence opt2 from VP1__Norovirus__BAS30284

SEQ ID NO: 14540 - RNA, 1623 nt, Artificial Sequence
  derived and/or modified sequence opt2 from VP1__Norovirus__BAS30287
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccuggaucaaccaguucuacacccucgcccccaugggcaacggcaccggccgccgccgcgcccucuga

SEQ ID NO: 14541 - RNA, 1623 nt, Artificial Sequence
  derived and/or modified sequence opt2 from VP1__Norovirus__BAS30290
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcuccauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14542 - RNA, 1623 nt, Artificial Sequence
  derived and/or modified sequence opt2 from VP1__Norovirus__BAS30293
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgccaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14543 - RNA, 1623 nt, Artificial Sequence
  derived and/or modified sequence opt2 from VP1__Norovirus__BAS30296
augaagauggccuccaaccacgucaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaucaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14544 - RNA, 1623 nt, Artificial Sequence; identical to SEQ ID NO: 13793
  derived and/or modified sequence opt2 from VP1__Norovirus__BAS30299

SEQ ID NO: 14545 - RNA, 1623 nt, Artificial Sequence
  derived and/or modified sequence opt2 from VP1__Norovirus__BAS30302
augaagauggccuccuccgacgccaaccccuucgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14546 - RNA, 1623 nt, Artificial Sequence
  derived and/or modified sequence opt2 from VP1__Norovirus__BAS30305
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccggcacccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14547 - RNA, 1626 nt, Artificial Sequence
  derived and/or modified sequence opt2 from VP1__Norovirus__BAS30308
augaagauggccuccaacgacgucaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccgucguccgcaucaucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14548 - RNA, 1623 nt, Artificial Sequence; identical to SEQ ID NO: 13252
  derived and/or modified sequence opt2 from VP1__Norovirus__BAS30311

SEQ ID NO: 14549 - RNA, 1623 nt, Artificial Sequence
  derived and/or modified sequence opt2 from VP1__Norovirus__BAS30314
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaacaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14550 - RNA, 1623 nt, Artificial Sequence
  derived and/or modified sequence opt2 from VP1__Norovirus__BAS30317
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcggcaccgcccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14551 - RNA, 1623 nt, Artificial Sequence; identical to SEQ ID NO: 14550
  derived and/or modified sequence opt2 from VP1__Norovirus__BAS30320

SEQ ID NO: 14552 - RNA, 1623 nt, Artificial Sequence
  derived and/or modified sequence opt2 from VP1__Norovirus__BAS30323
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14553 - RNA, 1623 nt, Artificial Sequence
  derived and/or modified sequence opt2 from VP1__Norovirus__BAS30326
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14554 - RNA, 1623 nt, Artificial Sequence; identical to SEQ ID NO: 13815
  derived and/or modified sequence opt2 from VP1__Norovirus__BAS30329

SEQ ID NO: 14555 - RNA, 1623 nt, Artificial Sequence
  derived and/or modified sequence opt2 from VP1__Norovirus__BAS30332
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucuccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaccccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaggucgccaccgacaccaacaacgacuucgacgccaaccagaacaccaaguucacccccgucggcgucauccaggacggcggcaccacccaccgcaacgagccccagcaguggguccuccccuccuacuccggccgcaacgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14556 - RNA, 1623 nt, Artificial Sequence
  derived and/or modified sequence opt2 from VP1__Norovirus__BAS30335
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccagaacuggaacuccuacgaccccaccgaggagauccccgccccccucggcacccccgacuucgucggcaagauccagggcguccucacccagaccacccgcaccgacggcuccacccgcggccacaaggccaccgucuacaccggcuccgccgaguucucccccaagcucggccgcguccaguucgccaccgacaccaacaacgacuucgacgccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14557 - RNA, 1623 nt, Artificial Sequence; identical to SEQ ID NO: 13792
  derived and/or modified sequence opt2 from VP1__Norovirus__BAS30338

SEQ ID NO: 14558 - RNA, 1623 nt, Artificial Sequence; identical to SEQ ID NO: 13292
  derived and/or modified sequence opt2 from VP1__Norovirus__BAS30341

SEQ ID NO: 14559 - RNA, 1623 nt, Artificial Sequence
  derived and/or modified sequence opt2 from VP1__Norovirus__BAS30344
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaucaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14560 - RNA, 1623 nt, Artificial Sequence; identical to SEQ ID NO: 13292
  derived and/or modified sequence opt2 from VP1__Norovirus__BAS30347

SEQ ID NO: 14561 - RNA, 1623 nt, Artificial Sequence; identical to SEQ ID NO: 13292
  derived and/or modified sequence opt2 from VP1__Norovirus__BAS30350

SEQ ID NO: 14562 - RNA, 1623 nt, Artificial Sequence
  derived and/or modified sequence opt2 from VP1__Norovirus__BAS30353
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14563 - RNA, 1623 nt, Artificial Sequence
  derived and/or modified sequence opt2 from VP1__Norovirus__BAS30356
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgagccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcggcaccacccaccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14564 - RNA, 1623 nt, Artificial Sequence; identical to SEQ ID NO: 13815
  derived and/or modified sequence opt2 from VP1__Norovirus__BAS30359

SEQ ID NO: 14565 - RNA, 1623 nt, Artificial Sequence; identical to SEQ ID NO: 13292
  derived and/or modified sequence opt2 from VP1__Norovirus__BAS30362

SEQ ID NO: 14566 - RNA, 1623 nt, Artificial Sequence; identical to SEQ ID NO: 13288
  derived and/or modified sequence opt2 from VP1__Norovirus__BAS30365

SEQ ID NO: 14567 - RNA, 1623 nt, Artificial Sequence; identical to SEQ ID NO: 13292
  derived and/or modified sequence opt2 from VP1__Norovirus__BAS30368

SEQ ID NO: 14568 - RNA, 1623 nt, Artificial Sequence; identical to SEQ ID NO: 13292
  derived and/or modified sequence opt2 from VP1__Norovirus__BAS30371

SEQ ID NO: 14569 - RNA, 1623 nt, Artificial Sequence
  derived and/or modified sequence opt2 from VP1__Norovirus__BAS30374
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgaggccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14570 - RNA, 1623 nt, Artificial Sequence
  derived and/or modified sequence opt2 from VP1__Norovirus__BAU16297
augaagauggccuccaacgacgacaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcgacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaacaaguucuacacccucgcccccaugggcaacggcaccggccgccgccgcgccgucuga

SEQ ID NO: 14571 - RNA, 1623 nt, Artificial Sequence
  derived and/or modified sequence opt2 from VP1__Norovirus__BAU16299
augaagauggccuccaacgacgccgcccccuccaacgacggcgccgccggccucguccccgagggcaacaacgagacccucccccucgagcccgucgccggcgccgccaucgccgcccccgucaccggccagaacaacaucaucgaccccuggauccgcaucaacuucguccaggcccccaacggcgaguucaccgucuccccccgcaacucccccggcgagauccuccucaaccucgagcucggccccgaccucaaccccuaccucgcccaccucucccgcgucuacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacuccaaccagcccaacucccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucacccucuccgagcucaccaacucccgcuuccccguccccaucgacucccucuucaccgcccacgacaacgucuggcagguccagugccagaacggccgcugcacccucgacggcgagcuccagggcaccacccagcuccuccccaccggcaucugcgccuuccgcggccgcgucaccgcccagaucaaccagcgcgaccgcuggcacaugcagcuccagaaccucaacggcaccaccuacgaccccaccgacgacguccccgccccccucggcacccccgacuucaagggcgucgucuucggcauggucucccagcgcaacgucggcaacgacgcccccggcuccacccgcgcccagcaggccugggucuccaccuacuccccccaguucguccccaagcucggcuccgucaaccuccgcaucuccgacaacgacgacuuccaguuccagcccaccaaguucacccccgucggcgucaacgacgacgacgacggccaccccuuccgccagugggagcuccccaacuacuccggcgagcucacccucaacaugaaccucgccccccccgucgcccccaacuuccccggcgagcagcuccucuucuuccgcuccuucguccccugcuccggcggcuacaaccagggcaucaucgacugccucaucccccaggaguggauccagcacuucuaccaggaguccgcccccucccaguccgacgucgcccucauccgcuacgucaaccccgacaccggccgcacccucuucgaggccaagcuccaccgcuccggcuacaucaccgucgcccacuccggcgacuacccccucgucguccccgccaacggccacuuccgcuucgacuccugggucaaccaguucuacucccucgcccccauggagaccggcaacggccgccgccgcgcccaguga

SEQ ID NO: 14572 - RNA, 1635 nt, Artificial Sequence
  derived and/or modified sequence opt2 from VP1__Norovirus__BAU16301
augaugauggccuccaaggacgccgcccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccgagcucgacggcucccccuucauggccuucgccgcccccgcccccgucggcuuccccgaccucggcuccugcgacuggcacaucgagauguccaagauccccaacuccuccacccaguccaaccccaucgucgucaacuccgucaagcccaacucccagcaguucgucccccaccucuccuccaucacccucgacgacaacgucuccuccggcggcgacuacaucggcaccauccaguggaccuccccccccuccggcuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucggcguccgccgcuga

SEQ ID NO: 14573 - RNA, 1623 nt, Artificial Sequence
  derived and/or modified sequence opt2 from VP1__Norovirus__BAU16303
augaugauggccuccaaggacguccccaccucccccgacggcgccuccggcgccggccagcucguccccgaggucaacaccgccgaccagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccacccucauccagggcauguucgucucccccgacgucaaccaguccguccaguuccagaacggccgcugccagaucgacggccagcuccagggcaccacccccgucucccucucccagcucugcaagauccgcggcaagaccuccuccaacacccgcguccucaaccucuccgaggucgacggcacccccuucgucccccucgagucccccgcccccgucggcuuccccgacaucggcggcugcgacuggcacgucggcuucaccuucgaggcccgcgaccagggccccucccagaacgucaccuucgccaccaacgacuccuccuucguccccuaccucggcuccaucuccccccacaacggcgacggcuuccacuccggcgacaucaucggcucccucgacuggaucuccgcccccuccgacggcuccgcccucgacgucugguccauccccaaguacggcuccucccuccccgacgucacccaccucgcccccgccgucuucccccccggcuucggcgaggucauccucuacuuccacuccaaguuccccggcuccggccccaccgacaagcuccgcguccccugccucaugccccaggaguucaucacccacuucugcgacgagcaggcccccaucgccggcgaggccgcccuccuccacuacgucgaccccgacgccggccgcaaccucggcgaguucaagcucuaccccgacggcuucaugaccugcguccccaacuccaucuccuccggcccccagacccuccccaucaacggcgucuucgucuucgucuccugggucucccgcuucuaccagcucaagcccgucggcaccgccuccauggcccgccgccucggccuccgccgcaucuga

SEQ ID NO: 14574 - RNA, 1647 nt, Artificial Sequence
  derived and/or modified sequence opt2 from VP1__Norovirus__BAU16305
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuucuccaccgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacgucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccgccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaucgucccccccgacggcuacuuccgcuucgaguccugggucaaccccuucuacacccucgcccccaugggcaucggcaacggccgccgccgcauccaguga

SEQ ID NO: 14575 - RNA, 1671 nt, Artificial Sequence
  derived and/or modified sequence opt2 from VP1__Norovirus__BAU16306
augaagauggccuccuccgacgccgcccccuccgccgacggcgccggcaaccucguccccgagucccagcaggagguccucccccucgcccccgucgccggcgccgcccucgccgcccccgucgucggccagaccaacaucaucgaccccuggaucaaggagaacuucguccaggccccccagggcgaguucaccgucucccccaagaacucccccggcgagauccucgucaaccucgagcucggccccaagcucaaccccuaccucgaccaccucucccgcauguacaacuccuacgccggcggcaucgacgucauggucguccucgccggcaacgccuucaccgccggcaagguccucaucgccgccaucccccccaacuuccccgucgagggcgucuccgccucccaggccacccaguucccccacgucaucaucgacguccgcacccucgaccccguccgccucccccuccccgacguccgcuccaccuucuuccacuacaccaacgacaccgagcccaagaugcgccucgucaucuggcucuacaccccccuccgcaccaacggcuccggcgacgacuccuucaccgucuccggccgcauccucacccgccccucccaggacuucgaguucgccuuccucaucccccccaccgucgagaccaagaccacccccuucuccguccccggcuucuccguccaggagauguccaacucccgcuggcccgccgccaucuccgccauggucguccgcggcaacgagccccaggucguccaguuccagaacggccgcgcccaccucgacggcaugcuccucggcaccacccccgucucccccaacuacaucgccuccuaccgcggcaucuccaccggcaacucccgcuccgccucccccgaggccgacgagcgcgccgucggcuccuucgacgucuggauccgccuccaggagcccgacggccagcccuacgacaucuucggcaagcagcccgcccccaucggcacccccgacuucaaggccgucaucgucggcuucgccgcccgcccccucaccuccggcuccuacgccaacgaggccuacgucaacaccaccgccuccgacuacgcccccgccaccggcaacaugcgcuucaccguccgcaacggcggcuccggccacaucuccgccaacaaguacugggaguucaaguccuucggcgucgagggcgagcgccacaccgacauccaguaccaggaguacgagcuccccgacuacuccggccaggucgccuccaaccacaaccucgccccccccgucgccccccgcaugcccggcgagucccuccuccucuuccaguccaacaugcccgucugggacgacggccacggcgaguccacccccaagaagauccacugccuccucccccaggaguucaucggccacuucuucgacaagcaggcccccucccucggcgacgccgcccuccuccgcuacgucaaccaggagaccaaccgcguccucuucgagugcaagcucuaccgcgacggcuacaucaccgucgccgccuccuccggccuccucgacuucccccucgacggcuucuuccgcuucgacuccugggucuccuccuucuacauccucucccccgucggcuccggccagggccgccgcggccgcguccgcuuccaguga

SEQ ID NO: 14576 - RNA, 1626 nt, Artificial Sequence
  derived and/or modified sequence opt2 from VP1__Norovirus__BAU16307
augaugauggccuccaaggacgccacccccuccgccgacggcgccaacggcgccggccagcucguccccgaggucaacaacgccgagccccucccccucgaccccgucgccggcgccuccaccgcccucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcgucauccucgccggcaacgccuucaccgccggcaaggucaucaucugcugcgucccccccggcuuccagucccgcacccucuccaucgcccaggccacccucuucccccacgucaucgccgacguccgcacccucgagccccucgagaucccccucgaggacguccgcaacacccucuaccacaacaacgacucccagcccaccaugcgccuccucugcaugcucuacaccccccuccgcaccggcggcggcuccggcggcaccgacgccuucgucgucgccggccgcguccucaccugccccucccccgacuucaacuuccucuuccucgucccccccaccgucgagcagaagacccgccccuucuccguccccaacaucccccuccagaaccucuccaacucccgcguccccucccucauccaguccaugguccucuccuccgaccacgcccagaccguccaguuccagaacggccgcugcaccaccgacggccaccuccucggcaccacccccgucuccuccggccagcucaugaaguuccgcggcaaggucacccccggcuccaagguccucaaccucaccgagcucgacggcucccccuuccucgccuucgagccccccgcccccgccggcuuccccgaccucggcaagugcgacuggcacaucgagaugucccucuaccaggucaacaaccaggacaaccccaucguccuccgcgccaucgagcccaacuccuccuccuucgucccccaccucggcuccgucuccuucaaccagaacgucgacgccgccggcgacuacgucugcaccauccaguacaccuccccccccuccaacucccacgacgccgacgucgacuucugguccauccccgacuacggcuccaaccucgccgaggccucccagcucgcccccgucgucuacccccccggcuucggcgaggccaucgucuacuucaugucccgcguccccggcuggaaccgcaccaaccgccucaaccucguccccugccuccucccccaggaguucaucggccacuucgucuccgagcaggcccccgccaucggcgaggccgcccuccuccacuacgucgaccccgacaccaaccgcaaccucggcgaguucaagcucuaccccgagggcuucaucaccugcguccccaacggcaccggcccccagcagcucccccucaacggcgucuucgucuucuccuccugggucucccgcuucuaccagcucaagcccgucggcaccgccuccuccgcccgcggccgccucggcauccgccgcuga

SEQ ID NO: 14577 - RNA, 1623 nt, Artificial Sequence; identical to SEQ ID NO: 13903
  derived and/or modified sequence opt2 from VP1__Norovirus__BAU24831

SEQ ID NO: 14578 - RNA, 1623 nt, Artificial Sequence; identical to SEQ ID NO: 13855
  derived and/or modified sequence opt2 from VP1__Norovirus__BAU24834

SEQ ID NO: 14579 - RNA, 1623 nt, Artificial Sequence
  derived and/or modified sequence opt2 from VP1__Norovirus__BAU24837
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucguccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14580 - RNA, 1623 nt, Artificial Sequence
  derived and/or modified sequence opt2 from VP1__Norovirus__BAU24840
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcacccuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14581 - RNA, 1623 nt, Artificial Sequence; identical to SEQ ID NO: 13855
  derived and/or modified sequence opt2 from VP1__Norovirus__BAU24843

SEQ ID NO: 14582 - RNA, 1623 nt, Artificial Sequence
  derived and/or modified sequence opt2 from VP1__Norovirus__BAU24846
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaucaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14583 - RNA, 1623 nt, Artificial Sequence; identical to SEQ ID NO: 13855
  derived and/or modified sequence opt2 from VP1__Norovirus__BAU24849

SEQ ID NO: 14584 - RNA, 1623 nt, Artificial Sequence
  derived and/or modified sequence opt2 from VP1__Norovirus__BAU24852
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14585 - RNA, 1623 nt, Artificial Sequence; identical to SEQ ID NO: 14582
  derived and/or modified sequence opt2 from VP1__Norovirus__BAU24855

SEQ ID NO: 14586 - RNA, 1623 nt, Artificial Sequence; identical to SEQ ID NO: 13903
  derived and/or modified sequence opt2 from VP1__Norovirus__BAU24858

SEQ ID NO: 14587 - RNA, 1623 nt, Artificial Sequence
  derived and/or modified sequence opt2 from VP1__Norovirus__BAU24861
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14588 - RNA, 1623 nt, Artificial Sequence; identical to SEQ ID NO: 13855
  derived and/or modified sequence opt2 from VP1__Norovirus__BAU24864

SEQ ID NO: 14589 - RNA, 1623 nt, Artificial Sequence
  derived and/or modified sequence opt2 from VP1__Norovirus__BAU24867
augaagauggccuccuccgacgccaaccccaccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14590 - RNA, 1623 nt, Artificial Sequence; identical to SEQ ID NO: 13903
  derived and/or modified sequence opt2 from VP1__Norovirus__BAU24870

SEQ ID NO: 14591 - RNA, 1623 nt, Artificial Sequence; identical to SEQ ID NO: 13855
  derived and/or modified sequence opt2 from VP1__Norovirus__BAU24873

SEQ ID NO: 14592 - RNA, 1623 nt, Artificial Sequence; identical to SEQ ID NO: 13855
  derived and/or modified sequence opt2 from VP1__Norovirus__BAU24876

SEQ ID NO: 14593 - RNA, 1623 nt, Artificial Sequence; identical to SEQ ID NO: 13855
  derived and/or modified sequence opt2 from VP1__Norovirus__BAU24879

SEQ ID NO: 14594 - RNA, 1623 nt, Artificial Sequence
  derived and/or modified sequence opt2 from VP1__Norovirus__BAU24882
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgagaccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14595 - RNA, 1623 nt, Artificial Sequence
  derived and/or modified sequence opt2 from VP1__Norovirus__BAU24885
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcgacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14596 - RNA, 1623 nt, Artificial Sequence; identical to SEQ ID NO: 13855
  derived and/or modified sequence opt2 from VP1__Norovirus__BAU24888

SEQ ID NO: 14597 - RNA, 1623 nt, Artificial Sequence
  derived and/or modified sequence opt2 from VP1__Norovirus__BAU24891
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14598 - RNA, 1623 nt, Artificial Sequence; identical to SEQ ID NO: 13903
  derived and/or modified sequence opt2 from VP1__Norovirus__BAU24894

SEQ ID NO: 14599 - RNA, 1623 nt, Artificial Sequence
  derived and/or modified sequence opt2 from VP1__Norovirus__BAU24897
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucguccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14600 - RNA, 1623 nt, Artificial Sequence; identical to SEQ ID NO: 13855
  derived and/or modified sequence opt2 from VP1__Norovirus__BAU24900

SEQ ID NO: 14601 - RNA, 1623 nt, Artificial Sequence; identical to SEQ ID NO: 13855
  derived and/or modified sequence opt2 from VP1__Norovirus__BAU24903

SEQ ID NO: 14602 - RNA, 1623 nt, Artificial Sequence; identical to SEQ ID NO: 14143
  derived and/or modified sequence opt2 from VP1__Norovirus__BAU24906

SEQ ID NO: 14603 - RNA, 1623 nt, Artificial Sequence; identical to SEQ ID NO: 13855
  derived and/or modified sequence opt2 from VP1__Norovirus__BAU24909

SEQ ID NO: 14604 - RNA, 1623 nt, Artificial Sequence; identical to SEQ ID NO: 13903
  derived and/or modified sequence opt2 from VP1__Norovirus__BAU24912

SEQ ID NO: 14605 - RNA, 1623 nt, Artificial Sequence
  derived and/or modified sequence opt2 from VP1__Norovirus__BAU24915
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14606 - RNA, 1623 nt, Artificial Sequence; identical to SEQ ID NO: 13855
  derived and/or modified sequence opt2 from VP1__Norovirus__BAU24918

SEQ ID NO: 14607 - RNA, 1623 nt, Artificial Sequence; identical to SEQ ID NO: 13855
  derived and/or modified sequence opt2 from VP1__Norovirus__BAU24921

SEQ ID NO: 14608 - RNA, 1623 nt, Artificial Sequence; identical to SEQ ID NO: 13855
  derived and/or modified sequence opt2 from VP1__Norovirus__BAU24924

SEQ ID NO: 14609 - RNA, 1623 nt, Artificial Sequence
  derived and/or modified sequence opt2 from VP1__Norovirus__BAU24927
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggagcucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14610 - RNA, 1623 nt, Artificial Sequence
  derived and/or modified sequence opt2 from VP1__Norovirus__BAU24930
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgucgucuga

SEQ ID NO: 14611 - RNA, 1623 nt, Artificial Sequence; identical to SEQ ID NO: 13815
  derived and/or modified sequence opt2 from VP1__Norovirus__BAU24933

SEQ ID NO: 14612 - RNA, 1623 nt, Artificial Sequence
  derived and/or modified sequence opt2 from VP1__Norovirus__BAU24936
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagcccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14613 - RNA, 1623 nt, Artificial Sequence
  derived and/or modified sequence opt2 from VP1__Norovirus__BAU24942
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14614 - RNA, 1623 nt, Artificial Sequence
  derived and/or modified sequence opt2 from VP1__Norovirus__BAU24945
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagacccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14615 - RNA, 1623 nt, Artificial Sequence
  derived and/or modified sequence opt2 from VP1__Norovirus__BAU24948
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccgcccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14616 - RNA, 1623 nt, Artificial Sequence; identical to SEQ ID NO: 13252
  derived and/or modified sequence opt2 from VP1__Norovirus__BAU24950

SEQ ID NO: 14617 - RNA, 1623 nt, Artificial Sequence; identical to SEQ ID NO: 14177
  derived and/or modified sequence opt2 from VP1__Norovirus__BAU24952

SEQ ID NO: 14618 - RNA, 1623 nt, Artificial Sequence
  derived and/or modified sequence opt2 from VP1__Norovirus__BAU24954
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcgcccccgacuucgucggcaagauccagggcaugcucacccagaccacccgcgccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgucgucuga

SEQ ID NO: 14619 - RNA, 1623 nt, Artificial Sequence; identical to SEQ ID NO: 13855
  derived and/or modified sequence opt2 from VP1__Norovirus__BAU24958

SEQ ID NO: 14620 - RNA, 1623 nt, Artificial Sequence
  derived and/or modified sequence opt2 from VP1__Norovirus__BAU24960
augaagauggccuccaacgacgccaaccccuccgacggccccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaucaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14621 - RNA, 1623 nt, Artificial Sequence; identical to SEQ ID NO: 13903
  derived and/or modified sequence opt2 from VP1__Norovirus__BAU24962

SEQ ID NO: 14622 - RNA, 1623 nt, Artificial Sequence; identical to SEQ ID NO: 14582
  derived and/or modified sequence opt2 from VP1__Norovirus__BAU24964

SEQ ID NO: 14623 - RNA, 1623 nt, Artificial Sequence; identical to SEQ ID NO: 14582
  derived and/or modified sequence opt2 from VP1__Norovirus__BAU24966

SEQ ID NO: 14624 - RNA, 1623 nt, Artificial Sequence
  derived and/or modified sequence opt2 from VP1__Norovirus__BAU24968
augaagauggccuccuccgacgccaaccccuccgacggcuccaccgccaaccucguccccgaggucaacaacgaggucauggcccucgagcccgucaucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14625 - RNA, 1623 nt, Artificial Sequence
  derived and/or modified sequence opt2 from VP1__Norovirus__BAU24972
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacaucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14626 - RNA, 1623 nt, Artificial Sequence
  derived and/or modified sequence opt2 from VP1__Norovirus__BAU24974
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaccacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14627 - RNA, 1623 nt, Artificial Sequence; identical to SEQ ID NO: 13911
  derived and/or modified sequence opt2 from VP1__Norovirus__BAU24976

SEQ ID NO: 14628 - RNA, 1623 nt, Artificial Sequence; identical to SEQ ID NO: 13903
  derived and/or modified sequence opt2 from VP1__Norovirus__BAU24978

SEQ ID NO: 14629 - RNA, 1623 nt, Artificial Sequence; identical to SEQ ID NO: 13903
  derived and/or modified sequence opt2 from VP1__Norovirus__BAU24980

SEQ ID NO: 14630 - RNA, 1623 nt, Artificial Sequence
  derived and/or modified sequence opt2 from VP1__Norovirus__BAU24982
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucgcccccaagcucggccgcauccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14631 - RNA, 1623 nt, Artificial Sequence; identical to SEQ ID NO: 13903
  derived and/or modified sequence opt2 from VP1__Norovirus__BAU24984

SEQ ID NO: 14632 - RNA, 1623 nt, Artificial Sequence; identical to SEQ ID NO: 13855
  derived and/or modified sequence opt2 from VP1__Norovirus__BAU24986

SEQ ID NO: 14633 - RNA, 1623 nt, Artificial Sequence
  derived and/or modified sequence opt2 from VP1__Norovirus__BAU24988
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcaugcucacccagaccaccaagggcgacggcuccacccgcggccacaaggccaccgucuacaccggcuccgcccccuucacccccaagcucggcuccguccaguucgagaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccguccccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14634 - RNA, 1623 nt, Artificial Sequence
  derived and/or modified sequence opt2 from VP1__Norovirus__BAU24990
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcggcaccacccaccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgccgucuga

SEQ ID NO: 14635 - RNA, 1623 nt, Artificial Sequence
  derived and/or modified sequence opt2 from VP1__Norovirus__BAU24992
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcuacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14636 - RNA, 1623 nt, Artificial Sequence; identical to SEQ ID NO: 13909
  derived and/or modified sequence opt2 from VP1__Norovirus__BAU24994

SEQ ID NO: 14637 - RNA, 1623 nt, Artificial Sequence
  derived and/or modified sequence opt2 from VP1__Norovirus__BAU24996
augaagauggccuccuccgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccgcgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14638 - RNA, 1623 nt, Artificial Sequence; identical to SEQ ID NO: 13903
  derived and/or modified sequence opt2 from VP1__Norovirus__BAU24998

SEQ ID NO: 14639 - RNA, 1623 nt, Artificial Sequence
  derived and/or modified sequence opt2 from VP1__Norovirus__BAU25002
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacugguccaacuacgaccccaccgaggagauccccgccccccucggcacccccgacuucgucggcaagauccagggcguccucacccagaccacccgcaccgacggcuccacccgcggccacaaggccaccgucuacaccggcuccgccgacuucgcccccaagcucggccgcguccaguucgagaccgacaccgaccacgacuucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14640 - RNA, 1623 nt, Artificial Sequence; identical to SEQ ID NO: 13855
  derived and/or modified sequence opt2 from VP1__Norovirus__BAU25004

SEQ ID NO: 14641 - RNA, 1644 nt, Artificial Sequence
  derived and/or modified sequence opt2 from VP1_protein__Norovirus__ADN84676
augaagauggccuccuccgacgccgcccccuccaccgacggcuccgccggccucguccccgaggucaacaacgagaccauggcccucgagcccgucgucggcgccccccucgccgcccccgucgccggccagcacaacaucaucgaccccuggaucaagaugaacuucguccaggcccccaacggcgaguucaccgucuccccccgcaacgcccccggcgagauccuccucgaccucgagcucggccccgaccucaaccccuaccucucccaccucgcccgcauguacaacggcuacgccggcggcauggagguccaggucguccucgccggcaacgccuucaccgccggcaagaucaucuucgccgccgucccccccaacuuccccgccgagaaccucuccgccgcccaggucaccaugugcccccacgucaucgucgacguccgccagcucgagcccgucaugcuccccaugcccgacauccgcaacaagcucuuccacuacaaccaggucgacgaccccaagcuccgccuccucgccuaccucuacaccccccuccgcgccaacaacgccggcgacgacgucuucaccgucuccugccgcguccucacccgccccacccccgacuucgaguucauguuccucgucccccccaccgucgaguccaagaccaagcccuucucccuccccaaccucacccucgacgagcucuccaacucccgcuuccccgcccccaucguccagcucuacaccaacccccacgacaaccucgucguccagccccagaacggccgcugcaccaucgacggccuccuccagggcaccacccagcucgucuccugcaacgucugcuccuuccgcggcaccaugggcgagggccagcccgccucccacuccgaggacgagaucaugcccauggccaucaacguccagcgcgagaucaugcucgagaaccucgacggcucccccuacgaccccaccgacgacauccccgccguccucggcucccccgacuuccagggcgucauguucggcauccucucccagcgcaacaccgacggccagacccgcgcccacgaggccaaggucgacacccgcgccgcccgcuucgcccccaagcucggcuucgucgucgccaccgucgaguccaccgacuuccacgccaaccagcccucccgcuucacccccgucggccucggcggcgacgccaaccgcgacuucaaccaguggcagcuccccgccuacggcggcgcccucaccaacaacaccaaccucgccccccccgucaugcccgucuaccccggcgagcagcuccucuucuuccgcucccagcuccccuccuccggcggcgucgucgccggcuggcucgacugccuccucccccaggaguggguccagcacuucuuccaggaguccgccaccucccaguccaacgucgcccucguccgcuacgucaaccccaccaccggccgcguccucuucgaggccaagcuccacaagcagggcuuccucaccgucgccgccuccggcuccuacccccucgucguccccgccgacggcuacuuccgcuucgaguccugggucaacgaguucuacacccucgcccccaugggcaacggcuccggccgccgccgcgcccgcuga

SEQ ID NO: 14642 - RNA, 1623 nt, Artificial Sequence
  derived and/or modified sequence opt2 from VP1_protein__Norovirus__BAK68870
augaagauggccuccaacgacgccucccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14643 - RNA, 1620 nt, Artificial Sequence
  derived and/or modified sequence opt2 from capsid__Norovirus__AAC54893
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagucccacgacuccacccucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaacuuccgcggcgacgucacccacaucgucggcucccacgacuacaccaugaaccucgccucccagaacugguccaacuacgaccccaccgaggagauccccgccccccucggcacccccgacuucgucggcaagauccagggccuccucacccagaccacccgcgccgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgaccaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccuccacuucuaccaggaggccgcccccgcccaguccgacgucgcccuccuccgcuucgucaaccccgacaccggccgcguccucuucgagugcaagcuccacaaguccggcuacaucaccgucgcccacaccggccccuucgaccucgucaucccccccaacggcuacuuccgcuucgacuccugggucaaccaguucuacacccucgcccccaugggcaacggcaccggccgccgccgcgcccucuga

SEQ ID NO: 14644 - RNA, 1647 nt, Artificial Sequence
  derived and/or modified sequence opt2 from capsid__Norovirus__AAW30195
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgagcucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacacccgccuccgccucaucgccaugcucuacaccccccuccgcgccaacuccuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcaugcucacccgcuccaccucccgcgccuccgaccaggccgacaccgccgccccccgccucuucaacuaccacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgaccucgaccagaaccagcccaccaaguucacccccgucggcaucggcgucgaccacgaggaggacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuucggcuucgaguccugggucaaccccuucuacacccucgcccccaugggcaccggcaacggccgccgccgcauccaguga

SEQ ID NO: 14645 - RNA, 1647 nt, Artificial Sequence
  derived and/or modified sequence opt2 from capsid__Norovirus__ABD36491
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaaggucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucacccgcuccaccucccgcgccuccgaccaggccgacaccgccaccccccgccucuucaacuacuacuggcacauccagcucgacaaccucaacggcacccccuacgaccccgccgaggacauccccgccccccucggcacccccgacuuccgcggcaaggucuucggcgucgccucccagcgcaaccccgacuccaccacccgcgcccacgaggccaaggucgacaccaccuccggccgcuucgcccccaagcucggcucccucgagaucuccaccgaguccuccgacuucgacuccaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14646 - RNA, 1629 nt, Artificial Sequence
  derived and/or modified sequence opt2 from capsid__Norovirus__ABD36494
augaagauggccuccaacgacgccgcccccuccaacgacggcgccgccucccucguccccgagggcaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaacaacgucguccagugccagaacggccgcugcacccucgacggcgagcuccagggcaccacccagcuccucuccuccgccaucugcuccuaccgcggccgcaccgucgccaacaacggcgacaacugggaccagaaccuccuccagcucaccuaccccaacggcgccuccuacgaccccaccgacgagguccccgccccccucggcacccaggacuucuccggcaugcucuacggcguccucacccaggacaacaccaacgucuccgccggcgaggccaagaacgccaagggcaucuacaucuccaccaccuccggcaaguucacccccaagaucggcuccaucggccuccacuccaucaccgagcacgucuaccccaaccagcagucccgcuucacccccgucggcgucgccgucaacgagaacacccccuuccagcaguggguccucccccacuacgccggcucccucgcccucaacaccaaccucgcccccgccgucgcccccaccuuccccggcgagcagcuccucuucuuccgcucccgcguccccugcguccagggccagcagggccaggacgucuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcauccaguga

SEQ ID NO: 14647 - RNA, 1614 nt, Artificial Sequence
  derived and/or modified sequence opt2 from capsid__Norovirus__ABD36497
augaagauggccuccaacgacgccgcccccuccuccgacggcgccgccggccucguccccgagaucaaccacgaggucauggccaucgagcccgucgccggcgccuccaucgccgcccccgucgucggccagcagaacaucaucgaccccuggauccgcaacaacuucguccaggcccccgccggcgaguucaccgucuccccccgcaacgcccccggcgaguuccuccucgaccucgagcucggccccgaccucaaccccuaccucgcccaccucgcccgcauguacaacggccacgccggcggcauggagguccagaucguccucgccggcaacgccuucaccgccggcaagauccucuucgccgucaucccccccggcuuccccuacgagaaccucucccccgcccagcucaccaugugcccccacgucgucgucgacguccgccagcucgagcccgucaugcuccccaugcccgacauccgcaacaccuucuuccacuacaaccaggacggcggcccccgccuccgccucaucgccaugcucuacaccccccuccgcgccaacaacuccggcgacgacgucuucaccgucuccugccgcguccucacccgccccgcccccgacuucgaguucaccuuccucgucccccccuccgucgaguccaagaccaaggccuucaccauccccguccucaagaucuccgagaugaccaacucccgcuuccccguccccgucgaccagauguacaccucccgcuccgagggcaucgucguccagccccagaacggccgcgccaccaucgacggcgagcuccucggcaccacccucgucucccccgucuccgucugcaacuucaagggcaaccuccagaccgagguccccggccagcaccagcaguaccagcuccagcucaccaaccucgacggcucccccaucgaccccaccgacgacacccccggcccccucggcugccccgacuucaucggccuccucuacggcgucgccucccagcgcggccccggcgacgccacccgcgcccacgaggcccgcaucgacaccggcuccgacaccuacgcccccaagaucggccagguccgcuucuacuccaccuccaacaacuucgagaccaaccagcccacccacuucacccccgucggcgucuacaucgagggcuccuccuccgacuucaaccaguggcagcucccccgcuacggcggccaccucgccaacaacaaccaccucgcccccgccgucuccccccucuuccccggcgagcagauccucuucuuccgcuccuucauccccggcgccuccggccacaccaacggcgagauggacugccuccucccccaggaguucguccagcacuucuaccaggaggccgccaccgcccaguccgaggucgcccuccuccgcuucgucaaccccgacaccggccgcguccucuucgaguccaagcuccacaagcagggcuucaugaccaucgccuccuccggcgaccaccccaucaucaugcccaccaacggcuacuuccgcuucgaggccugggucaaccaguucuacucccucgcccccgucggcaccggcuccggccgccgccgcauccaguga

SEQ ID NO: 14648 - RNA, 1623 nt, Artificial Sequence
  derived and/or modified sequence opt2 from capsid__Norovirus__ABL74387
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgaggccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgccuacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14649 - RNA, 1623 nt, Artificial Sequence
  derived and/or modified sequence opt2 from capsid__Norovirus__ABL74389
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccauccgccucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagguccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14650 - RNA, 1623 nt, Artificial Sequence; identical to SEQ ID NO: 13702
  derived and/or modified sequence opt2 from capsid__Norovirus__ABL74397

SEQ ID NO: 14651 - RNA, 1593 nt, Artificial Sequence
  derived and/or modified sequence opt2 from capsid__Norovirus__ABQ44562
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccggcaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcgucuccuccggcaacuacaucggcguccucuccugggucuccccccccucccaccccuccggcucccaggucgaccucuggaagauccccaacuacggcuccuccaucaccgaggccacccaccucgcccccuccgucuacccccccggcuucggcgagguccucgucuucuucauguccaagauccccggccccggcgccuacucccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccaccgcccgcggccgccucggccuccgccgcuga

SEQ ID NO: 14652 - RNA, 1638 nt, Artificial Sequence
  derived and/or modified sequence opt2 from capsid__Norovirus__ABQ44563
augaugauggccuccaagggcgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgucgcccagaacaucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugauggucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucaacaccggcgacgucaucaagcagaucaacgucaagcaggaguccgccuucgccccccaccucggcaccauccaggccgacggccucuccgacgucuccgucaacaccaacaugaucgccaagcucgagugggucucccccgucuccgacggccacaagggcgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacuccuccggcaccggcccccagacccuccccaucaacggcgucuucgucuucgucuccugggucucccgcuucuaccagcucaagcccgucggcaccgccggccccgcccgccgccucggcauccgccgcuccuga

SEQ ID NO: 14653 - RNA, 1635 nt, Artificial Sequence
  derived and/or modified sequence opt2 from capsid__Norovirus__ABQ44564
augaugauggccuccaaggacgccacccccuccgccgacggcgccaccggcgccggccagcucguccccgaggucaacaccgccgaccccauccccaucgaccccgucgccggcuccuccaccgcccucgccaccgccggccaggucaaccucaucgaccccuggaucaucaacaacuucguccaggccccccagggcgaguucaccaucucccccaacaacacccccggcgacguccucuucgaccuccagcucggcccccaccucaaccccuuccucucccaccucucccagauguacaacggcugggucggcaacaugcgcguccgcgucguccucgccggcaacgccuucaccgccggcaaggucaucaucugcugcgucccccccggcuuccagucccgcacccucuccaucgcccaggccacccucuucccccacgucaucgccgacguccgcacccucgaccccgucgaggucccccucgaggacguccgcaacguccucuaccacaacaacgacacccagcccaccaugcgccuccucugcaugcucuacaccccccuccgcaccggcggcgccuccggcggcaccgacuccuucgucgucgccggccgcguccucaccugccccggccccgacuucaacuuccucuuccucgucccccccaccgucgagcagaagacccgccccuucaccguccccaacaucccccucaaguaccucuccaacucccgcauccccaaccccaucgagggcaugucccucucccccgaccagacccagaacguccaguuccagaacggccgcugcaccaucgacggccagccccucggcaccacccccgucuccgucucccagcucugcaaguuccgcggccgcaucaccuccggccagaagguccucaaccucaccgagcucgacggcucccccuucauggccuucgccgcccccgcccccgccggcuuccccgaccucggcuccugcgacuggcacaucgaggucuccaagauccccaacuccuccacccaguccaaccccaucgucgucaacuccgucaagcccaacucccagcaguucgucccccaccucuccuccaucacccucgacgacaacgucuccuccggcggcgacuacaucggcaccauccaguggaccuccccccccuccgacuccggcggcgccaacaccaacuucuggaagauccccgacuacggcuccucccucgccgaggccucccagcucgcccccgccgucuacccccccggcuucaacgaggucaucgucuacuucauggccuccauccccggccccaaccaguccggcucccccaaccucguccccugccuccucccccaggaguacaucacccacuucaucuccgagcaggcccccauccagggcgaggccgcccuccuccacuacgucgaccccgacaccaaccgcaaccucggcgaguucaagcucuaccccggcggcuaccucaccugcguccccaacuccuccuccaccggcccccagcagcucccccucgacggcgucuucgucuucgccuccugggucucccgcuucuaccagcucaagcccgucggcaccgccggccccgcccgcggccgccucggcguccgccgcuga

SEQ ID NO: 14654 - RNA, 1623 nt, Artificial Sequence
  derived and/or modified sequence opt2 from capsid__Norovirus__ABQ44565
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuuccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacgucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcucccccuucaucccccucgagucccccgcccccgucggcuuccccgaccucggcggcugcgacuggcacgucaacuucaccuuccaggcccaggaccaggaccccucccaguccgucaccuucgccaccaacgacgccuccuucguccccuaccucggcuccaucuccccccacaacggcggcgacuuccacuccggcgacaucaucggcucccucggcuggaucuccgcccccuccgacuccucccagcucaacgucuggaccauccccaaguacggcuccucccuccccgacgucacccaccucgcccccgccgucuucccccccggcuucggcgaggucauccucuacuucuacuccaccuuccccggcuccggccagcccggccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgucgcccgccgccucggccuccgccgcaucuga

SEQ ID NO: 14655 - RNA, 1635 nt, Artificial Sequence
  derived and/or modified sequence opt2 from capsid__Norovirus__ABQ44566
augaugauggccuccaaggacgcccccaccaacauggacggcaccuccggcgccggccagcucguccccgaggccaacaccgccgagcccaucuccauggaccccgucgccggcgccgccaccgccgucgccaccgccggccagaucaacaugaucgaccccuggaucauguccaacuucguccaggccccccagggcgaguucaccgucucccccaacaacacccccggcgacguccucuucgaccuccagcucggcccccagcucaaccccuuccucgcccaccucgcccagauguacaacggcugggucggcaacaugcgcgucaagguccuccucgccggcaacgccuucaccgccggcaagaucaucaucuccugcaucccccccggcuucaccucccagaacaucuccaucgcccagaugaccauguucccccacgucaucgccgacguccgcguccucgagcccaucgaggucccccucgaggacguccgcaacguccucuuccacaccaacgacaaccgccccaccaugcgccucgucugcaugcucuacaccccccuccgcgccaacggcuccuccuccggcaccgaccccuucgucaucgccggccgcguccucaccugccccgacuccaacuucuccuuccucuuccucgucccccccaacgucgagcagaagacccgccccuucuccguccccaacaucccccucaacacccucuccaacucccgcguccccucccucaucaaguccaugaccaucucccgcgaccagaaccagaucauccaguuccagaacggccgcgucacccucgacggccagcuccagggcaccacccccaccuccgucucccagcucugcaagauccgcggcaccaccuaccacgccaccggcggcaacggcaucaaccucaccgagcucaacggcgagcccuaccacgccuucgagucccccgcccccaucggcuuccccgaccucggcggcugcgacuggcaccucaccgccacccccacccaggccuucaacgacggcgccaaggucguccgccucuccgucacccagggcgccgccuucgccccccaccucggcaccauccacuacaccaccaccgacaccgacuacucccccaacaccuccaucaucugcacccucgacuggcucucccagaccaccggccaguccaacgucgaccccuggcagauccccaccuacggcuccacccucaccgaggccgcccagcucgccccccccaucuucccccccggcuucggcgagacccucgucuucuuccucuccgacuuccccaucuccaacggcaagaacggccucuccguccccugcacccucccccaggaguucgucacccacuucgucaacgagcaggcccccauccgcggcgaggccgcccuccuccacuacgucgaccccgacacccaccgcaaccucggcgaguucaagcucuaccccgagggcuucaugaccugcguccccaacaccuccggcggcggcccccagacccuccccaucaacggcgucuucgucuucgucuccugggucucccgcuucuaccagcucaagcccgucggcaccgccggcgccgcccgccgccucggcauccgccgcuccuga

SEQ ID NO: 14656 - RNA, 1608 nt, Artificial Sequence
  derived and/or modified sequence opt2 from capsid__Norovirus__ABQ44567
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagauccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuuccccaucgagaaccucucccccggccagaucaccauguucccccacgucaucaucgacguccgcacccucgagcccguccuccucccccuccccgacguccgcaacaacuucuuccacuacaaccaggagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccgcccccaucgacgagcucuacaccucccccaacgagggccucgucguccagccccagaacggccgcuccacccucgacggcgagcuccucggcaccacccagcucguccccuccaacaucugcucccuccgcggccgcaucaacgcccaccuccccgacaaccagcaccgcuggaacaugcaggucaccaacgccaacggcacccccuucgaccccaccgaggacguccccgccccccucggcacccccgacuuccucgccaacaucuacggcgucaccucccagcgcaaccccgacaacaccugccgcgcccacgacggcauccucgccaccuggucccccaaguucacccccaagcucggcuccgucguccucggcaccugggaggaccgcgacuucgacaucaaccagcccacccgcuucacccccgucggccucuacgacaccgaccacuucaaccagugggcccuccccaacuacuccggcgcccucacccucaacaugaaccucgcccccuccgucgccccccucuuccccggcgagcagcuccucuucuuccgcucccacaucccccucaagggcggcaccuccuccggcgccaucgacugccuccucccccaggaguggguccagcacuucuaccaggaguccgcccccuccuccaccgacgucgcccucauccgcuacaccaaccccgacaccggccgcguccucuucgaggccaagcuccaccgccagggcuucaucaccgucgccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 14657 - RNA, 1629 nt, Artificial Sequence
  derived and/or modified sequence opt2 from capsid__Norovirus__ABQ44568
augaacauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgucuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacgucaccaucaccaaccucaacggcucccccuucgaccccuccgaggacauccccgccccccucggcguccccgacuuccagggccgcgucuucggcgucaucucccagcgcgacaagcagaacgccgccggccacaacgagcccgccaaccgcggccacgacgccgucguccccaccuacaccgcccaguacacccccaagcucggccagauccagaucggcaccuggcagaccgacgaccucaccgucaaccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 14658 - RNA, 1647 nt, Artificial Sequence
  derived and/or modified sequence opt2 from capsid__Norovirus__ABQ44569
augaagauggccuccaacgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14659 - RNA, 1623 nt, Artificial Sequence
  derived and/or modified sequence opt2 from capsid__Norovirus__ABQ44570
augaagauggccuccaacgacgccgcccccuccaacgacggcgccgccggccucguccccgaguccaacaacgaggccauggcccucgagcccgucaugggcgccucccucgccgcccccgucaccggccagaccaacaucaucgaccccuggauccgcaccaacuucguccaggcccccaacggcgaguucaccgucuccccccgcaacucccccggcgagauccucgucaaccucgagcucggccccgagcucaaccccuaccucgcccaccucgcccgcauguacaacggcuacgccggcggcauggagguccaggucaugcucgccggcaacgccuucaccgccggcaagaucaucuucgccgccgucccccccuacuuccccgucgagaaccucucccccucccagaucaccauguucccccacgucaucaucgacguccgcacccucgagcccguccuccuccccaugcccgacguccgcuccacccucuuccacuucaaccagaaggacgagcccaagaugcgccucgucgccaugcucuacaccccccuccgcuccaacggcuccggcgacgacgucuucaccgucuccugccgcauccucacccgccccucccccgaguucgacuucaccuaccucgucccccccaccgucgaguccaagaccaagcccuucacccuccccguccucacccucggcgagcucuccaacucccgcuucccccucuccaucgacgagauggucaccucccccaacgaguccaucgucguccagccccagaacggccgcgucacccucgacggcgagcuccucggcaccacccagcuccaggccugcaacaucugcuccauccgcggcaaggucaccggccagguccccaacgagcagcacauguggaaccucgaggucaccaaccucaacggcacccaguucgaccccaccgacgacguccccgccccccucggcguccccgacuucgccggcgaggucuucggcguccucucccagcgcaaccgcggcgaguccaaccccgccaaccgcgcccacgacgccgucgucgccaccuacuccgacaaguacacccccaagcucggccucguccagaucggcaccuggaacaccaacgacgucgagaaccagcccaccaaguucacccccaucggccucaacgaggucgccaacggccaccgcuucgagcaguggacccucccccgcuacuccggcgcccucacccucaacaugaaccucgcccccgccgucgccccccucuuccccggcgagcgccuccucuucuuccgcuccuacaucccccucaagggcggcuucggcaaccccgccaucgacugccucgucccccaggaguggguccagcacuucuaccaggaguccgcccccucccucggcgacgucgcccucguccgcuacgucaaccccgacaccggccgcguccucuucgaggccaagcuccacaagggcggcuuccucaccgucuccuccaccuccaccggccccgucgucguccccgccaacggcuacuuccgcuucgacuccugggucaaccaguucuacucccucgcccccaugggcaccggcaacggccgccgccgcuuccaguga

SEQ ID NO: 14660 - RNA, 1653 nt, Artificial Sequence
  derived and/or modified sequence opt2 from capsid__Norovirus__ABQ44571
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgacaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgccgccaucgacaugcucuacaccgaccccaacgaguccaucgucguccagccccagaacggccgcugcacccucgacggcacccuccagggcaccacccagcucguccccacccagaucugcgccuuccgcggcacccucaucucccagaccgcccgcgccgccgacuccaccgacuccccccagcgcgcccgcgaccacccccuccacguccaggucaagaaccucgacggcacccaguacgaccccaccgacgacauccccgccguccucggcgccaucgacuucaagggcaccgucuucggcgucgccucccagcgcgacgucuccggcccccaggagcagggccacuacgccacccgcgcccacgaggcccacaucgacaccaccgaccccaaguacgcccccaagcucggcaccauccucaucaaguccgaguccaacgacuucaucaccaaccagcccauccgcuucacccccgucggcaugggcgacaacaacuggcgccagugggagcuccccgacuacuccggccgccucacccucaacaugaaccucgcccccgccgucucccccuccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucguccgcuacgucaaccccgacaccggccgcaacaucuucgaggccaagcuccaccgcgagggcuuccucaccgucgccaacuccggcaacaaccccaucgucgucccccccaacggcuacuuccgcuucgaggccugggucaaccaguucuacacccucgcccccaugggcuccggccagggccgccgccgcgcccaguga

SEQ ID NO: 14661 - RNA, 1623 nt, Artificial Sequence
  derived and/or modified sequence opt2 from capsid__Norovirus__ABQ44572
augaagauggccuccaacgacgccgcccccuccuccgacggcgccgccggccucguccccgagaucaacaacgaggucaugccccucgaccccgucgccggcgccucccucgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuuccccuacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucgucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgacgucauguacaccgcccgcaacgagaaccaggucguccagccccagaacggccgcgucacccucgacggcgagcuccucggcaccaccccccuccucgccgucaacaucugcaaguucaagggcgaggucaucgccaagaacggcgacguccgcuccuaccgcauggacauggagaucaccaacaccgacggcacccccaucgaccccaccgaggacacccccggccccaucggcucccccgacuuccagggcauccucuucggcgucgccucccagcgcaacaagaacgagcagaaccccgccacccgcgcccacgaggccaacaucaacaccggcggcgaccaguacgcccccaagcucgcccaggucaaguucuucuccgagucccaggacuucgagguccaccagcccaccaccuucacccccgucggcgucgccggcgacaacucccaccccuuccgccaguggacccucccccgcuacggcggccaccucaccaacaacacccaccucgcccccgccgucgccccccucuuccccggcgagcagcuccucuucuuccgcucccagauccccuccuccggcggccacgaguccggcuacauggacugccucgucccccaggaguggguccagcacuucuaccaggaggccgccaccgcccaguccgaggucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcguccaguga

SEQ ID NO: 14662 - RNA, 1608 nt, Artificial Sequence
  derived and/or modified sequence opt2 from capsid__Norovirus__ABQ44573
augaagauggccuccaacgacgccgcccccuccaacgacggcgccgccggccucguccccgaggccaacaacgagaccauggcccucgagcccgucgccggcgccuccaucgccgccccccucaccggccagaacaacaucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgucccccucggcacccccgacuucuccggcaagcucuucggcguccucucccagcgcgaccacgacaacgccugccgcucccacgacgccgucaucgccaccaacuccgccaaguucacccccaagcucggcgccauccagaucggcaccugggaggagaacgacguccacaucaaccagcccaccaaguucacccccgucggccucuucgaggacgagggcuucaaccaguggacccuccccaacuacuccggcgcccucacccucaacgucggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccaguccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 14663 - RNA, 1614 nt, Artificial Sequence
  derived and/or modified sequence opt2 from capsid__Norovirus__ABQ44574
augaagauggccuccaacgacgccacccccuccgacgacggcgccgccggccucguccccgagaucaacaacgaggucauggcccucgagcccgucgccggcgccuccaucgccgcccccgucgucggccagcagaacaucaucgaccccuggauccgcaacaacuucguccaggcccccgccggcgaguucaccgucuccccccgcaacucccccggcgagcuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgccaucccccccuccuuccccuacgagaaccucucccccgcccagcucaccaugugcccccacgucaucgucgacguccgccagcucgagcccguccuccuccccaugcccgacauccgcaacgucuucuaccacuacaaccagaacaacucccccaagcuccgccucgucgccaugcucuacaccccccuccgcgccaacaacuccggcgacgacgucuucaccgucuccugccgcguccucacccgccccucccccgacuuccaguucaccuuccucgucccccccaccgucgaguccaagaccaagaacuucacccuccccguccuccgcgucuccgagaugaccaacucccgcgucccccgcugcuucggcaccaagugcauccaggcccgcaacgagaacaucaucguccagccccagaacggccgcugcaccaccgacggcgagcuccucggcaccaccacccuccaguccgucuccaucugcaacuuccgcggcaccaugcaggccaagcucaacgagcagccccgcuaccagcuccagcucaccaaccucgacggcucccccaucgaccccaccgacgacaugcccgccccccucggcacccccgacuuccaggccaugcucuacggcgucgccucccagcgcuccucccgcgacaacgccacccgcgcccacgacgcccagaucgacaccgccggcgacaccuucgcccccaagaucggccagguccgcuucaaguccuccuccggcgacuucgaccuccacgaccccaccaaguucacccccaucggcgucaacgucgacgaccagcaccccuuccgccaguggucccuccccaacuacggcggccaccucgcccucaacaaccaccucgcccccgccgucaccccccucuuccccggcgagcagauccucuucuuccgcucccacauccccuccgccggcggccacaccgacggcgccauggacugccuccucccccaggaguggaucgagcacuucuaccaggaggccgcccccucccaguccgacaucgcccucguccgcuucaucaaccccgacaccggccgcguccuccucgaggccaagcuccacaagcagggcuuccucaccgucgccgccuccggcgaccaccccaucgucaugcccaccaacggcuacuuccgcuucgaggccugggucaaccccuucuacacccucgcccccgucggcaccggcuccggccgccgccgcauccaguga

SEQ ID NO: 14664 - RNA, 1641 nt, Artificial Sequence
  derived and/or modified sequence opt2 from capsid__Norovirus__ABQ44575
augaagauggccuccaacgacgccgcccccuccaacgacggcgccgccucccucguccccgagggcaucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaccaacgucguccagugccagaacggccgcugcacccucgacggcgagcuccagggcaccacccagcuccucuccuccgccgucugcuccuaccgcggccgcaccgucgccaacaacggcgacaacugggaccagaaccuccuccagcucaccuaccccaacggcgccuccuacgaccccaccgacgagguccccgccccccucggcacccaggacuucuccggcaugcucuacggcguccucacccaggacaacgucaacgucuccaccggcgaggccaagaacgccaagggcaucuacaucuccaccaccuccggcaaguucacccccaagaucggcuccaucggccuccacuccaucaccgagcacguccaccccaaccagcagucccgcuucacccccgucggcgucgccgucaacgagaacacccccuuccagcaguggguccucccccacuacgccggcucccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccgcccccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcauccaguga

SEQ ID NO: 14665 - RNA, 1623 nt, Artificial Sequence
  derived and/or modified sequence opt2 from capsid__Norovirus__ABQ44576
augaagauggccuccaacgacgccgcccccuccaacgacggcgccgccggccucguccccgaggucaacaacgagacccucgcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucgcccgcauguacaacggcuacgccggcggcgucgagguccagguccuccucgccggcaacgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacuccuucuuccacuacaaccagcaguccgaccagcgcaugcgccucaucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucuccguccccguccucacccucaacgagcucaccaacucccgcuuccccguccccaucgacgccauguacaccucccccaacgacuccaucgucguccagccccagaacggccgcgccaccaucgacggcgagcuccucggcaccacccagcucauccccuccggcaucugcuccuuccgcggcaagaucaccacccaccucuccgacgaccgccaccucuggaacauccaggucaccaaccucaacggcacccccuucgaccccaccgacgacguccccgccccccucggcaugcccgacuucuccggccagaucuucggcgucgucucccagcgcgacaccggcaccaaccccgccaaccgcgcccacgacgccguccucgccaccuacuccgccaaguacacccccaagcucggcuccguccagaucggcaccugggacaccgaggaccuccucgagcgccagcccgucaaguucacccccgucggccucaacgagaucggccaggacaagcacuucgaccaguggguccuccccaacuacuccggcgcccucggccucaacaugcaccucgcccccgccgucuccccccucuuccccggcgagcgccuccucuucuuccgcuccuacaucccccucaagggcggccacggcgaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaaggagggcuucaucaccgucuccuccaccgagaaccgccccgucgucgucccccccaacggcuacuuccgcuucgacuccugggucaaccaguucuacucccucgcccccaugggcaccggcaacggccgccgccgcaugcaguga

SEQ ID NO: 14666 - RNA, 1569 nt, Artificial Sequence
  derived and/or modified sequence opt2 from capsid__Norovirus__ACJ04900
augaagaugaccgaccgcgacaccaucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagacccccuucacccuccccaaccuccccgucaacucccucucccacucccgcgccauggagcccaucgcccagaugauguccucccgcaacuuccccgccuccguccaguuccagaacggccgcugcacccucuccggcgaccuccucggcaccacccccuccucccccgccgacgucggcaccuucgucggccucaucgccgagcccggcucccacgucgucgagcucucccagcccaaccaggaggacuuccacgccggcuccgcccccgcccccuucggcuuccccgacuucuccgacugcucccucaccuucgucgucgccuccgccuccaccgucggcgagcgcaccgucaacacccgcuccccccagaacuucacccccgcccucggccacaucaccuucgacgaggaggcccccgccgaccucuuccgcgcccaccuccgcaaccucugggaccccaccgagcacuccuucuggcgcauccccgacuaccgcgccgacguccucggcggcgaguucgcccccuccgucuccgcccccggcgucggcgagacccuccucuucuucaugugcaacgucccccgcuccaacggcgccaaccccaaccccugccccugccuccucccccaggaguggaucacccacuucgucuccgagcgcgccgcccuccaguccgacgucgcccuccucaacuacaucaaccccaacaccggccgcguccucuucgagugcaagcucuacgccaacggcuuccucaccgucaaccucggcgccuccgaccaggccacccuccccgucgacggcaucuucaaguucgucuccugggucuccuucuacuaccagcuccgccccgucggcaacaucggcgucggccgccgccucccccgccucgacggcuucuga

SEQ ID NO: 14667 - RNA, 1569 nt, Artificial Sequence
  derived and/or modified sequence opt2 from capsid__Norovirus__ACJ04903
augaagaugaccgaccgcgacaccaucgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagacccccuucacccuccccaaccuccccgucaacucccucucccacucccgcgucauggagcccaucgcccagaugauguccucccgcaacuuccccgccuccguccaguuccagaacggccgcugcacccucuccggcgaccuccucggcaccacccccuccucccccgccgaccucggcaccuucgucggccucaucgccgagcccggcucccacgucgccgagcucucccagcccaaccaggaggacuuccacgccggcuccgcccccgcccccuucggcuuccccgacuucuccgagugcucccucaccuucgucgucgccuccgccuccaccgucggcgagcgcaccgucaacacccgcucccuccagaacuucacccccgcccucggccacaucaccuucgacgaggaggcccccgccgaccucuuccgcgcccaccuccgcaaccucugggaccccaccgagcacuccuucuggcgcauccccgacuaccgcgccgacguccucggcggcgaguucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacaucaaccccaacaccggccgcguccucuucgagugcaagcucuacgucaacggcuuccucaccgucaaccucggcgccuccgaccaggccacccuccccgucgacggcaucuucaaguucgucuccugggucuccuucuacuaccagcuccgccccgucggcaacaucggcgucggccgccgccucccccgccucgacggcuucuga

SEQ ID NO: 14668 - RNA, 1569 nt, Artificial Sequence
  derived and/or modified sequence opt2 from capsid__Norovirus__ACJ04906
augaagaugaccgaccgcgacgucaccgacuccgcccccgcccucggccagguccucccccccgaggucgaggccuccguccccgucgagcccaccgccggcgcccccgucgccgcccccaccgccggccaggucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacaaccucucccacucccgcgucauggagcccaucgcccagaugauguccucccgcaacuuccccgccuccguccaguuccagaacggccgcugcacccucuccggcgaccuccucggcaccacccccuccucccccuccgaccucggcgccuucgucggccucaucgccgagcccggcucccgcgucgucgagcucucccagcccaaccaggaggacuuccacgccggcuccgcccccgcccccuucggcuuccccgacuucuccgacugcucccucaccuucgucgucgccuccgccaccaccgucggcgagcgcaccgucaacgcccgcuccccccagaacuucacccccgcccucggccacaucaccuucgacgaggaggcccccgccgaccucuuccgcgcccaccuccgcaaccucugggaccccaccgagcacuccuucuggcgcauccccgacuaccgcgccgacguccucggcuccgaguucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucccccgccucgacggcuucuga

SEQ ID NO: 14669 - RNA, 1623 nt, Artificial Sequence
  derived and/or modified sequence opt2 from capsid__Norovirus__ACY00565
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccaguccggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacgucgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14670 - RNA, 1623 nt, Artificial Sequence; identical to SEQ ID NO: 14496
  derived and/or modified sequence opt2 from capsid__Norovirus__ACY00568

SEQ ID NO: 14671 - RNA, 1623 nt, Artificial Sequence
  derived and/or modified sequence opt2 from capsid__Norovirus__ACY00571
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccaaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14672 - RNA, 1623 nt, Artificial Sequence
  derived and/or modified sequence opt2 from capsid__Norovirus__ACY00573
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcgacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14673 - RNA, 1623 nt, Artificial Sequence
  derived and/or modified sequence opt2 from capsid__Norovirus__ACY00576
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacucccgcuucgaccccugggucaaccaguucuacacccucgcccccaugggcaacggcaccggccgccgccgcgcccucuga

SEQ ID NO: 14674 - RNA, 1623 nt, Artificial Sequence
  derived and/or modified sequence opt2 from capsid__Norovirus__ACY00579
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuccaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcggcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14675 - RNA, 1623 nt, Artificial Sequence
  derived and/or modified sequence opt2 from capsid__Norovirus__ACY00582
augaagauggccuccaacgacgccaaccccuccgacggcuccgucgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgacuccaccaucaagcucaucgccaugcucuacaccccccuccgcgccgacaacgccggcgaggacgucuucaccgucuccugccgcguccucacccgccccucccccgacuucgacuucaucuuccucgucccccccaccgucgaguccaagaccaagcccuucaccguccccauccucaccgucgaggagaugaccaacucccgcuuccccaucccccucgagaagcucuucaccggccccuccuccaccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacucccgcuucgacuccugggucaaccaguucuacacccucgcccccaugggcaacggcaccggccgccgccgcgcccucuga

SEQ ID NO: 14676 - RNA, 1623 nt, Artificial Sequence
  derived and/or modified sequence opt2 from capsid__Norovirus__ACY00588
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggccauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcucccuccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14677 - RNA, 1623 nt, Artificial Sequence
  derived and/or modified sequence opt2 from capsid__Norovirus__ACY00594
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccacggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14678 - RNA, 1623 nt, Artificial Sequence
  derived and/or modified sequence opt2 from capsid__Norovirus__ACY00597
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucggcguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuucaagggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14679 - RNA, 1623 nt, Artificial Sequence
  derived and/or modified sequence opt2 from capsid__Norovirus__ACY00600
augaagauggccuccaacgacgccaaccccuccgacggccccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcuccuccaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacacccagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagucccgcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14680 - RNA, 1623 nt, Artificial Sequence
  derived and/or modified sequence opt2 from capsid__Norovirus__ACY00603
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgcccucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccccacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14681 - RNA, 1623 nt, Artificial Sequence
  derived and/or modified sequence opt2 from capsid__Norovirus__ACY00606
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaugauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacggccucgucaucccccccaacggcuacuuccgcuucgacuccugggucaaccaguucuacacccucgcccccaugggcaacggcaccggccgccgccgcgcccucuga

SEQ ID NO: 14682 - RNA, 1623 nt, Artificial Sequence
  derived and/or modified sequence opt2 from capsid__Norovirus__ACY00609
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccgaccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugcccccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14683 - RNA, 1623 nt, Artificial Sequence
  derived and/or modified sequence opt2 from capsid__Norovirus__ACY00612
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucaugggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14684 - RNA, 1632 nt, Artificial Sequence
  derived and/or modified sequence opt2 from capsid__Norovirus__ACY00615
augaugauggccuccaaggacgcccccaccaacauggacggcaccuccggcgccggccagcucguccccgaggccaacaccgccgagccccuccccaucaagcccgucgccggcgccgccaccgccgucgccaccgccggccaggucaacaugaucgaccccuggaucaugaacaacuucguccaggccccccagggcgaguucaccaucucccccaacaacacccccggcgacauccucuucgaccuccagcucggcccccaccucaaccccuuccucgcccaccucucccgcauguacaacggcugggucggcaacaugcagguccgcaucaugcucgccggcaacgccuucuccgccggcaagaucaucgucugcugcaucccccccggcuucuccucccaguccaucuccaucgcccaggccaccauguucccccacgucaucgccgacguccgcguccucgagcccaucgacgucccccucgacgacguccgcaacguccucuuccacaacaacgacaacccccagaccaugcgccuccucugcaugcucuacaccccccuccgcuccggcggcaccuccuccggcaccgaccccuucgucaucgccggccgcguccucaccugccccacccccgacuucuccuuccucuuccucgucccccccgacaucgagcagcgcaccaagcccuucuccguccccaacauccccaugaaccucauguccaacucccgcgucuccaugcucaucgacggcaugauggucuccaacgaccagaaccaggucccccaguuccagaacggccgcgucacccucgacggccagcuccaggacaccaccaccgucuccgccgccugcgucgcccgcaugcgcggccgcaucuucaacaacaacggcaacuacggcgucaaccucaccgagcucgacggcaaccccuaccacgccuucgacucccccgccccccucggcuuccccgacuucggcaacugcgaccuccacaugaccuucgucaagaucaaccccaacgagcucuccuccggcgaccccuccggcaaggucgucauccacuccuacgacgccaccuucgccccccaccucggcaccgucaagcucgagaacgacgacgagcucgcccgcuucgucggcaaggaggucguccucgagcucaccugggucuccaaccgcgagggcgccacccucaaccucugggccguccccaacuacggcuccucccucacccaggccucccagcucgccccccccaucuacccccccggcuucggcgaggccaucgucuacuucaccuccaccuuccccaccgucuccaaccccaagguccccugcacccucccccaggaguucgucucccacuucgucaacgagcaggcccccacccgcggcgacgccgcccuccuccacuacgucgaccccgacacccaccgcaaccucggcgaguucaagauguaccccgagggcuacaugaccugcguccccaacgccggcggcggcccccagacccuccccaucaacggcgucuucgucuucaucuccugggucucccgcuacuaccagcucaagcccgucggcaccgccggcgccgcccgccgccucggccuccgccgcuccuga

SEQ ID NO: 14685 - RNA, 1623 nt, Artificial Sequence
  derived and/or modified sequence opt2 from capsid__Norovirus__ACY00618
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacauggucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccagacccaggaccgcgaccccucccaguccgucaccuucgccaccaacgacgccuccuucguccccuaccucggcuccgucuccccccacaacggcgagggcuuccaggccggcgacaucaucggcucccucggcuggaucuccgcccccuccgacaacucccaguucaacgucugggccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 14686 - RNA, 1623 nt, Artificial Sequence
  derived and/or modified sequence opt2 from capsid__Norovirus__ACY00621
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucaucccccucgagucccccgcccccgucggcuuccccgaccucggcggcugcgacuggcacgucaacuucaccuuccagacccaggaccgcgaccccucccaguccgucaccuucgccaccaacgacgccuccuucguccccuaccucggcuccgucuccccccacaacggcgagggcuuccaggccggcgacaucaucggcucccucggcuggaucuccgcccccuccgacaacucccaguucaacgucugggccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 14687 - RNA, 1611 nt, Artificial Sequence
  derived and/or modified sequence opt2 from capsid__Norovirus__ACY00623
augaagauggccuccaacgacgccacccccuccgacgacggcgccgccggccucguccccggcaucaacuccgaggucauggcccucgagcccgucgccggcgccuccaucgccgcccccgucgucggccagcagaacaucaucgaccccuggauccgcaacaacuucguccaggcccccgccggcgaguucaccgucuccccccgcaacucccccggcgagcuccuccucgaccucgagcucggccccgagcucaaccccuaccucgcccaccucgcccgcauguacaacggccacgccggcggcauggagguccagaucguccucgccggcaacgccuucaccgccggcgagauccucuucgccgccaucccccccuccuuccccuacgagaaccucucccccgcccagcucaccaugugcccccacgucaucgucgacguccgccagcucgagcccguccuccuccccaugcccgacauccgcaacgucuucuaccacuacaaccagaacaacucccccaagcuccgccucgucgccaugcucuacaccccccuccgcgccaacaacuccggcgacgacgucuucaccgucuccugccgcguccucacccgccccucccccgacuuccaguucaccuuccucgucccccccaccgucgaguccaagaccaagaacuucacccuccccguccuccgcgucuccgagaugaccaacucccgcuuccccgucguccucgaccagauguacaccucccgcaacgagaacaucaucguccagccccagaacggccgcugcaccaccgacggcgagcuccucggcaccaccauccuccaguccgucuccaucugcaacuucaagggcaccaugcaggccaagcucaacgaggagccccgcuaccagcuccagcucaccaaccucgacggcucccccaucgaccccaccgacgacaugcccgccccccucggcacccccgacuuccaggccaugcucuacggcgucgccucccagcgcuccuccaccgacaacgccacccgcgcccacgacgcccagaucgacaccgccggcgacaccuucgcccccaagaucggccagguccgcuucaaguccuccuccaacgacuucgaccuccacgaccccaccaaguucacccccaucggcgucaacgucgacgaccagcaccccuuccgccaguggucccuccccaacuacggcggccaccucgcccucaacaaccaccucgcccccgccgucaccccccucuuccccggcgagcagauccucuucuuccgcuccuacauccccuccgccggcggccacaccgacggcgccauggacugccuccucccccaggagugggucgagcacuucuaccaggaggccgcccccucccaguccgacaucgcccucguccgcuucaucaaccccgacaccggccgcguccucuucgaggccaagcuccacaagcagggcuuccucaccaucgccgccuccggcgaccaccccaucgucaugcccaccaacggcuacuuccgcuucgaggccugggucaaccccuucuacacccucgcccccgucggcaccggcuccggccgccgccgcauccaguga

SEQ ID NO: 14688 - RNA, 1647 nt, Artificial Sequence
  derived and/or modified sequence opt2 from capsid__Norovirus__ACY00629
augaagauggccuccaucgacgccgcccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuucgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacuccaagcuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucguccccaugggcaccggcaacggccgccgccgcauccaguga

SEQ ID NO: 14689 - RNA, 1614 nt, Artificial Sequence
  derived and/or modified sequence opt2 from capsid__Norovirus__ACY00632
auggccuccaacgacgccgcccccuccaacgacggcgccaccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacaucgucguccagccccagaacggccgcugcacccucgacggcgagcuccagggcaccacccagcuccucaccaccgccaucugcuccuaccgcggcaugaccuccaaccccaccuccgacuacugggacgaccaccuccuccaccucguccaccccaacggcgccaccuacgaccccaccgaggacguccccgcccccuucggcacccaggacuuccgcggcauccucuacggcaugcucacccagaacccccgcaccuccggcgacgaggccgccaacucccacggcaucuacaucuccuccaccuccgagaaguucacccccaagcucggcaccaucggccuccaccagguccagggccgccacucccagcaccagcaguccaaguucacccccgucggcaucgccgucaacggcaacacccccuuccgccagugggagcuccccaacuacuccggcgcccucacccucaacaccaaccucgcccccgccgucggccccaacuuccccggcgagcagauccucuucuuccgcuccaacguccccuccguccagggcggccagcccaucgagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacuccugggucaaccaguucuacgcccucgcccccaugggcaccggcaacggccgccgccgcguccaguga

SEQ ID NO: 14690 - RNA, 1617 nt, Artificial Sequence
  derived and/or modified sequence opt2 from capsid__Norovirus__ACY00635
augaagauggccuccaacgacgccgcccccuccaacgacggcgccgccggccucguccccgagaucaacaacgaggucauggcccucgagcccgucgccggcggcgccaucgccgccccccucaccggccagaccaacgucaucgaccccuggauccgcaccaacuucguccaggcccccaacggcgaguucaccaucuccccccgcaacucccccggcgagguccuccucaacauggagcucggccccgagcucaaccccuuccucggccaccucucccgcauguacaacggcuacgccggcggcaucgagguccagguccucauggccggcaacgccuucaccgccggcaaggucaucuucgccgccguccccccccacuuccccgucgagaaccucucccccccccaggucaccauguucccccacgucaucgucgacguccgcacccucgagcccauccuccucccccuccccgacguccgcaaccaguucuuccacuacucccaggucgacgagcccaagaugcgccucgucgccaugcucuacaccccccuccgcuccaacggcuccgccgaggacgucuucaccgucuccugccgcguccucacccgccccucccccgacuucgaguucaacuaccucgucccccccaccgucgagucccgcaccaagcccuucaccguccccauccucaccaucggcgagauguccaacucccgcuuccccgcccccaucgacgucaucuacaccucccccaacgacaaccagaacguccagccccagaacggccgcugcacccucgacggcgagcuccagggcaccacccagcucguccccuccggcgucugcgccuuccgcggccgcaucaccucccacgagggcuccgagcagaaccaguggcacaugcagcucaccaaccucaacggcacccccuucgaccccaccgaggacauccccgccccccucggcacccccgacuucaagggcgagaucuucggcuucaucucccagcgcaacgcccagaacgaccccggccagucccagcccgccaaccgcgcccacgacgccgucgucuccacccgcgcccccaaguucacccccaagcucggcuccgucaugaucggcaccugggucaacuccgacaucgagaaccagcccuccaaguucacccccgucggccucaacuccuccgagaacuucaagcagugggagcuccccgacuacuccggcguccucacccucaacaugggccucgcccccgucguccaccccaccuaccccggcgagcagauccucuucuuccgcuccuacaucccccucaagggcggccacggcaaccccgccaucgacugccuccucccccaggaguggauccagcacuucuaccaggaguccgcccccucccagaccgacgucgcccuccucaaccccgacaccggccgcguccucuucgaggccaagcuccaccgccagggcuacaucaccaucgccaaguccggcgacggccccaucgucgucccccccaacggcuacuuccgcuucgacuccugggucaaccaguucuacucccucgcccccaugggcaacggcaacggccgccgccgcguccaguga

SEQ ID NO: 14691 - RNA, 1632 nt, Artificial Sequence
  derived and/or modified sequence opt2 from capsid__Norovirus__ACY00638
augaugauggccuccaaggacgcccccaccaacauggacggcaccuccggcgccggccagcucguccccgaggucuccaccgccgagcccaucuccauggagcccgucgccggcgccgccaccgccgccgccaccgccggccaggucaacaugaucgaccccuggaucauguccaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaagguccgcguccuccucgccggcaacgccuucaccgccggcaagaucaucaucuccugcgucccccccggcuucgccgcccagaacgucuccaucgcccaggccaccauguucccccacgucaucgccgacguccgcguccucgagcccaucgaggucccccucgaggacguccgcaacguccucuuccacaacaacgacuccacccccaccaugcgccucaucugcaugcucuacaccccccuccgcgccuccggcuccuccuccggcaccgaccccuucgucaucgccggccgcguccucaccugccccucccccgacuucaacuuccucuuccucgucccccccaacgucgagcagaagaccaagcccuucuccguccccgaccucccccucaacguccucuccaacucccgcguccccucccucaucaaguccaugauggucucccaggaccacggccagaugguccaguuccagaacggccgcgucacccucgacggccagcuccagggcaccacccccaccuccgccucccagcucugcaagauccgcggcaccgucuaccacgccaccggcggccagggccucaaccucaccgagaucgacggcacccccuaccacgccuucgagucccccgcccccaucggcuuccccgaccucggcgagugcgacuggcacaucaacgccucccccgccaacgccuucaccgacggcuccaucauccaccgcaucgacgucguccaggaccccaccuucgccccccaccucggcaccauccacuacaccaacgccaacuacgacgccaacgucucccucaucugcucccucgaguggcucuccccccccuccggcggcgcccucaaggccaaccccugggccaucccccgcuacggcuccacccucaccgaggccgcccagcucgccccccccaucuacccccccggcuucggcgaggccaucgucuucuucauguccgacuuccccaucgccaacggcuccgacggccucuccguccccugcaccaucccccaggaguucgucacccacuucgucaacgagcaggcccccacccgcggcgaggccgcccuccuccacuacgucgaccccgacacccaccgcaaccucggcgaguucaagcucuaccccgagggcuucaugaccugcguccccaacuccuccggcuccggcccccagacccuccccaucaacggcgucuucaccuucaucuccugggucucccgcuucuaccagcucaagcccgucggcaccaccggccccguccgccgccucggcauccgccgcuccuga

SEQ ID NO: 14692 - RNA, 1635 nt, Artificial Sequence
  derived and/or modified sequence opt2 from capsid__Norovirus__ACY00641
augaugauggccuccaaggacgcccccaccaacauggacggcaccuccggcgccggccagcucguccccgaggccaacaccgccgagcccaucuccauggaccccgucgccggcgccgccaccgccgucgccaccgccggccagaucaacaugaucgaccccuggaucauguccaacuucguccaggccccccagggcgaguucaccgucucccccaacaacacccccggcgacguccucuucgaccuccagcucggcccccagcucaaccccuuccucgcccaccucgcccagauguacaacggcugggucggcaacaugcgcgucaagguccuccucgccggcaacgccuucaccgccggcaagaucaucaucuccugcaucccccccggcuucaccucccagaacaucuccaucgcccagaugaccauguucccccacgucaucgccgacguccgcguccucgagcccaucgagaucccccucgaggacguccgcaacguccucuuccacaccaacgacaaccgccccaccaugcgccucgucugcaugcucuacaccccccuccgcgccaacggcuccuccuccggcaccgaccccuucgucaucgccggccgcguccucaccugccccgacuccaacuucuccuuccucuuccucgucccccccaacgucgagcagaagacccgccccuucuccguccccaacaucccccucaacacccucuccaacucccgcguccccucccucaucaaguccaugaccaucucccgcgaccagaaccagaucauccaguuccagaacggccgcgucacccucgacggccagcuccagggcaccacccccaccuccgucucccagcucugcaagauccgcggcaccaccuaccacgccaccggcggcuccggcaucaaccucaccgagcucaacggcgagcccuaccacgccuucgagucccccgcccccaucggcuuccccgaccucggcggcugcgacuggcaccucaccgccacccccacccaggccuucaacgacggcgccaaggucguccgccucuccgucacccagggcgccgccuucgccccccaccucggcaccauccacuacaccaccaccgacaccgacuacaaccccaacaccuccaucaucugcacccucgacuggcucucccagaccaccggccaguccaacgucgaccccuggcagauccccaccuacggcuccacccucaccgaggccgcccagcucgccccccccaucuucccccccggcuucggcgagacccucgucuucuuccucuccgacuuccccaucuccaacggcaagaacggccucuccguccccugcacccucccccaggaguucgucacccacuucgucaacgagcaggcccccauccgcggcgaggccgcccuccuccacuacgccgaccccgacacccaccgcaaccucggcgaguucaagcucuaccccgagggcuucaugaccugcguccccaacaccuccggcggcggcccccagacccuccccaucaacggcgucuucgucuucgucuccugggucucccgcuucuaccagcucaagcccgucggcaccgccggcgccgcccgccgccucggcauccgccgcuccuga

SEQ ID NO: 14693 - RNA, 1635 nt, Artificial Sequence
  derived and/or modified sequence opt2 from capsid__Norovirus__ACY00645
augaugauggccuccaaggacgcccccaccaacauggacggcaccuccggcgccggccagcucguccccgaggccaacaccgccgagcccaucuccauggaccccgucgccggcgccgccaccgccgucgccaccgccggccagaucaacaugaucgaccccuggaucauguccaacuucguccaggccccccagggcgaguucaccgucucccccaacaacacccccggcgacguccucuucgaccuccagcucggcccccagcucaaccccuuccucgcccaccucgcccagauguacaacggcugggucggcaacaugcgcgucaagguccuccucgccggcaacgccuucaccgccggcaagaucaucaucuccugcaucccccccggcuucaccucccagaacaucuccaucgcccagaugaccauguucccccacgucaucgccgacguccgcguccucgagcccaucgagaucccccucgaggacguccgcaacguccucuuccacaccaacgacaaccgccccaccaugcgccucgucugcaugcucuacaccccccuccgcgccaacggcuccuccuccggcaccgaccccuucgucaucgccggccgcguccucaccugccccgacuccaacuucuccuuccucuuccucgucccccccaacgucgagcagaagacccgccccuucuccguccccaacaucccccucaacacccucuccaacucccgcguccccucccucaucaaguccaugaccaucucccgcgaccagaaccagaucauccaguuccagaacggccgcgucacccucgacggccagcuccagggcaccacccccaccuccgucucccagcucugcaagauccgcggcaccaccuaccacgccaccggcggcuccggcaucaaccucaccgagcucaacggcgagcccuaccacgccuucgagucccccgcccccaucggcuuccccgaccucggcggcugcgacuggcaccucaccgccacccccacccaggccuucaacgacggcgccaaggucguccgccucuccgucacccagggcgccgccuucgccccccaccucggcaccauccacuacaccaccaccgacaccgacuacaaccccaacaccuccaucaucugcacccucgacuggcucucccagaccaccggccaguccaacgucgaccccuggcagauccccaccuacggcuccgcccucaccgaggccgcccagcucgccccccccaucuucccccccggcuucggcgagacccucgucuucuuccucuccgacuuccccaucuccaacggcaagaacggccucuccguccccugcacccucccccaggaguucgucacccacuucgucaacgagcaggcccccauccgcggcgaggccgcccuccuccacuacgucgaccccgacacccaccgcaaccucggcgaguucaagcucuaccccgagggcuucaugaccugcguccccaacaccuccggcggcggcccccagacccuccccaucaacggcgucuucgucuucgucuccugggucucccgcuucuaccagcucaagcccgucggcaccgccggcgccgcccgccgccucggcauccgccgcuccuga

SEQ ID NO: 14694 - RNA, 1635 nt, Artificial Sequence
  derived and/or modified sequence opt2 from capsid__Norovirus__ACY00647
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacauccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccgcccagaacaucuccaucgcccaggccaccauguucccccacgucaucgccgacguccgcguccucgagcccaucgaggucccccucgaggacguccgcaacguccucuuccacaacaacgacaacucccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaacgccaugaugaucucccgcgaccacggccagaugguccaguuccagaacggccgcgucacccucgacggccagcuccagggcaccacccccaccucccucucccagcucugcaagauccgcggcaaggucuuccacgccuccggcggcaacggccucaaccucaccgagcucgacggcuccgccuaccacgccuucgagucccccgcccccaucggcuuccccgacaucggcgagugcgacuggcacaugaacgccaccgccaccuccaacuucaccggcuccaacgacgaguaccagauccucgucaagcaggaguccaccuucgccccccaccucggccacguccaggccgacucccucuccgccgacgccaacaccgaccucauggucucccucuccuggaucucccccgucuccgaccagcaccgccgcgacgucgaccccugggucaucccccgcuacggcuccucccucaccgaggccgcccagcucgccccccccaucuacccccccggcuucggcgaggccaucgucuucuucauguccgacuuccccgucgucuccggcgucaacggcaugcgcauccccugcacccucccccaggaguacgucgcccacuucgucaacgagcaggcccccacccgcggcgaggccgcccuccuccacuacgucgaccccgacacccaccgcaaccucggcgaguucaagauguaccccgagggcuucaugaccugcguccccaacuccuccggcuccggcccccagacccuccccaucaacggcguccucaccuucgucuccugggucucccgcuucuaccagcucaagcccgucggcaccgccggccccgcccgccgccucggcauccgccgcuccuga

SEQ ID NO: 14695 - RNA, 1668 nt, Artificial Sequence
  derived and/or modified sequence opt2 from capsid__Norovirus__ACY00650
augcgcauggccuccuccgacgcccccgucuccggcaccgacggcgccgccggccucguccccgagucccagcaggagguccucccccucgagcccgucgccggcguccagcucgccgcccccgucgccggccaguccaacaucaucgaccccuggauccgcaugaacuucguccaggcccccgccggcgaguucaccgucuccccccgcgacgcccccggcgagguccucaucgaccucgagcucggccccgagcucaaccccuaccucaaccaccucgcccgcauguacaacggcuacgucggcggcauggaggucgaggucguccucgccggcaacgccuucaccgccggcaagauccucuucgccgccgucccccccuccuuccccacccacggcaucuccgccgcccaggccaccaugcucccccacgucaucgucgacguccgccagcucgagcccguccgccucccccuccccgacguccgcaacgucauguuccacuucugccaggagaacaaggagccccgcaugcgcaucgucgccauccucuacaccccccuccgcgccaacggcgccggcgacgacgucuucaccgucuccugccgcguccucacccgccccucccccgacuucgacuucaucuuccucguccuccccuccgucgaguccaagcucaagcaguucacccuccccaaccuccagcccaacgagaugaccaacucccgcuuccccaccggcaucauccagcucuacaccucccccaacaccaaccucgucguccaguuccagaacggccgcugccuccucgacggcacccuccucggcaccacccccguccgcgccgccgacaucugcuccuuccgcggcgucaccuccaccgaggucgacgccaccgacuccccccgcgucgccggcucccaccgcaucaugguccagcucaaggagcccgacggcgaggaguucucccccaccggccccaaccccgcccccgucggcacccccgacuuccaggccgccaucuucggcacccucucccagcgcaacaccggcggcgccggccagaacuccaaccgcgcccgcuucgccuacuucuacacccgcaaccccaccuucgcccccggcaucggcaccgucgucuucuccuucgacaccaccgacuuccagaaccgccagcccaccaaguucucccccuccggcgucuucgacgacgacuccuccgagcccuucaaccaguucucccuccccuacuacaacggcucccucggcgccgucgacgccggcaagcucgccccccccgucgcccccaacuaccccggcgagcagauccucuacuuccgcggcaacauccccuucaagggcggcuacggcgagggcgagaucgacucccuccucccccaggaguggaucacccacuucuacgccgagcaggcccccacccagggcgacgccgcccuccuccgcuacuacaaccccgacaccggccgcguccucuucgagugcaagcuccaccgcgagggcuucaucaccaucaacuacaccggcuccaacgcccucgccguccccgucaacggcgucuuccgcuucgagggcugggucaacaaguucuacacccucacccccaugggcaacggcaacggccgccgcggccgccgccgcgagcucuga

SEQ ID NO: 14696 - RNA, 1617 nt, Artificial Sequence
  derived and/or modified sequence opt2 from capsid__Norovirus__ACY00656
auggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacaacuucuuccacuacaaccagcaguccgaccagcgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucuccguccccguccucacccucaacgagcucaccaacucccgcuuccccguccccaucgacgccauguacaccucccccaacgacuccaucgucguccagccccagaacggccgcgccaccaucgacggcgagcuccucggcaccacccagcucauccccuccggcaucugcuccuuccgcggcaagaucaccacccaccucgccgacgaccgccaccucuggaacauccaggucuccaaccucaacggcacccccuucgaccccaccgacgacguccccgccccccucggcaugcccgacuucuccggccagaucuucggcgucgucucccagcgcgacaccggcaccaaccccgccaaccgcgcccacgacgccguccucgccaccuacuccgccaaguacacccccaagcucggcuccguccagaucggcaccugggacaccgaggaccuccucgagcgccagcccgucaaguucacccccgucggccucaacgagaucggccaggacaagcacuucgaccaguggguccuccccaacuacuccggcgcccucggccucaacaugcaccucgcccccgccgucuccccccucuuccccggcgagcgccuccucuucuuccgcuccuacaucccccucaagggcggccacggcgaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaagggcggcuucaucaccgucuccuccaccgagaaccgccccgucaucgucccccccaacggcuacuuccgcuucgacuccugggucaaccaguucuacucccucgcccccaugggcaccggcaacggccgccgccgcaugcaguga

SEQ ID NO: 14697 - RNA, 1623 nt, Artificial Sequence
  derived and/or modified sequence opt2 from capsid__Norovirus__ADK47170
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgccgagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14698 - RNA, 1644 nt, Artificial Sequence
  derived and/or modified sequence opt2 from capsid__Norovirus__ADR30514
augaagauggccuccaacgacgccgcccccuccaacgacggcgccgccgaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugucccucgcccccgccgucgcccccgccuuccccggcgagcgcauccucuucuuccgcuccaucguccccuccgccggcggcuacggcuccggccagaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 14699 - RNA, 1623 nt, Artificial Sequence
  derived and/or modified sequence opt2 from capsid__Norovirus__ADR78255
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14700 - RNA, 1623 nt, Artificial Sequence
  derived and/or modified sequence opt2 from capsid__Norovirus__ADR78259
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14701 - RNA, 1623 nt, Artificial Sequence
  derived and/or modified sequence opt2 from capsid__Norovirus__ADR78262
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacacccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14702 - RNA, 1623 nt, Artificial Sequence
  derived and/or modified sequence opt2 from capsid__Norovirus__ADR78266
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucuccggcucccgcaacuacaccaugaaccucgccucccagaacuggaacuccuacgaccccaccgaggagauccccgccccccucggcacccccgacuucgucggcaagauccagggcguccucacccagaccacccgcaccaacggcuccacccgcggccacaaggccaccgucuacaccggcuccgccgacuucucccccaagcucggccgcguccaguucgccaccgacaccgacaacgacuucgagaccaaccagaacaccaaguucacccccgucggcgucauccaggacggcuccaccaccccccgcaacgagccccagcaguggguccuccccuccuacuccggccgcaacauccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14703 - RNA, 1623 nt, Artificial Sequence; identical to SEQ ID NO: 14700
  derived and/or modified sequence opt2 from capsid__Norovirus__ADR78268

SEQ ID NO: 14704 - RNA, 1569 nt, Artificial Sequence
  derived and/or modified sequence opt2 from capsid__Norovirus__AFQ00093
augaagaugaccgaccgcgacaucgucgacuccgcccccgcccucggccagguccucccccccgaggucgaggccuccguccccgucgagcccaccgccggcgcccccgucgccgccuccaccgccggccgcgucaaccccaucgaccccuggaucuucgccaacuucguccaggccccccagggcgaguucaccaucucccccaacaacaaccccggcgagauccucuucgagcucgagcucggccccgaccucaaccccuaccucgcccaccuccgccgcauguacaacggcuggaccggcuccaugcgcguccgcguccuccucgccggcaacgccuucuccgccggcaaggucgucgucuucugcgucccccccggcuucgacaccuccuaccucacccccucccaggccacccaguucccccacguccucaucgacguccgcgcccccgagcccgucgacaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagccccccuucacccuccccaaccuccccgucaacucccucucccacucccgcgucauggagcccaucgcccagaugauguccucccgcuccuuccccgccuccguccaguuccagaacggccgcugcacccucuccggcgaccuccucggcaccacccccuccucccccgccgaccucggcgccuucgucggccucaucgccgagcccggcucccgcgucgucgagcucucccagcccaaccaggaggacuuccacgccggcuccgcccccgcccccuucggcuuccccgacuucuccgagugcuccgucaccuucgucgucgccuccgccaccaccgucggcgagcgcaccgucaacgcccgcaacccccagaacuucacccccgcccucggccacaucaccuucgacgaggaggcccccgccgaccucuuccgcgcccgcuuccgcaaccucugggagcccaccgagcacuccuucuggcgcauccccgacuaccgcgccgacguccucggcuccgacuucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccaguccgacgucgcccuccucaacuacgucaaccccaacaccggccgcguccucuucgaggccaagcucuacgccaacggcuuccucaccgucaaccucggcgccuccgaccaggccauccuccccgucgacggcaucuucaaguucgucuccugggucuccuucuacuaccagcuccgccccgucggcaacaucuccgucggccgccgccucccccgccucgacggcuucuga

SEQ ID NO: 14705 - RNA, 1629 nt, Artificial Sequence
  derived and/or modified sequence opt2 from capsid__Norovirus__BAI52939
augaagauggccuccaacgacgccgcccccuccaccgacggcgccgccggccucguccccgaguccaacaacgaggucauggcccucgagcccgucgccggcgccgcccucgccgcccccgucaccggccagaccaacaucaucgaccccuggauccgcgccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccaucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagcucuccaacucccgcuuccccgccuccaucgaccagauguacaccucccccaacgaggucaucuccguccagugccagaacggccgcugcacccucgacggcgagcuccagggcaccacccagcuccaggucuccggcaucugcgccuucaagggcgaggucaccgcccaccuccacgacaacgaccaccucuacaacaucaccaucaccaaccucaacggcucccccuucgaccccuccgaggacauccccgccccccucggcaugcccgacuuccagggccgcgucuucggcaucaucucccagcgcgaccgccacaacucccccggccacaacgagcccgccaaccgcggccacgacgccgucguccccaccuacaccgcccaguacacccccaagcucggccagauccagaucggcaccuggcagaccgacgaccucaccgucucccagcccgucaaguucacccccgucggccucaacgacaccgagcacuucaaccagugggucgucccccgcuacgccggcgcccucaaccucaacaccaaccucgcccccuccgucgcccccgucuuccccggcgagcgccuccucuucuuccgcuccuacaucccccucaagggcggcuacggcaaccccgccaucgacugccuccucccccaggaguggguccagcacuucuaccaggaggccgcccccuccauguccgaggucgcccucguccgcugcaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcguccaguga

SEQ ID NO: 14706 - RNA, 1623 nt, Artificial Sequence
  derived and/or modified sequence opt2 from capsid__Norovirus__BAI52940
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucggccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccgcaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14707 - RNA, 1623 nt, Artificial Sequence
  derived and/or modified sequence opt2 from capsid__Norovirus__BAQ20801
augaagauggccuccuccgacgccaaccccuccgacggcuccgccgccaaccucguccccgaggucaacaacgaggacauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucucccccaagcucggccgcguccaguucgagaccgacaccgaccacgacuucgaggucaaccagaacaccaaguucacccccgucggcgucauccaggacggcggcaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14708 - RNA, 1623 nt, Artificial Sequence
  derived and/or modified sequence opt2 from capsid__Norovirus__BAQ20803
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccucccagaacuggaacaacuacgaccccaccgaggagauccccgccccccucggcacccccgacuucgucggcaagauccagggcguccucacccagaccacccgcaccgacggcuccacccgcggccacaaggccaccgucuacaccggcuccgccaacuucucccccaagcucggccgcguccaguucgagaccgacaccgaccacgacuucgaggucaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14709 - RNA, 1623 nt, Artificial Sequence
  derived and/or modified sequence opt2 from capsid__Norovirus__BAQ20805
augaagauggccuccuccgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccggcgagucccgcaccaagcccuucuccguccccguccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaccaccggcucccacaacuacaccaugaaccucgccucccagaacuggaacaacuacgaccccaccgaggagauccccgccccccucggcacccccgacuucgucggcaagauccagggcaugcucacccagaccacccgcaccgacggcuccacccgcggccacaaggccaccgucuacaccggcuccgccgacuucgcccccaagcucggccgcguccaguucggcaccgacaccgaccacgaccucgaggccaaccagaacaccaaguucacccccgucggcgucauccaggacggcuccaccacccaccgcaacgagccccagcaguggguccuccccuccuacuccggccgcaacacccccaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14710 - RNA, 1647 nt, Artificial Sequence
  derived and/or modified sequence opt2 from capsid_protein__Norovirus__AAB06271
augaagauggccuccaaccgcgccgcccccuccaacgacggcgccgccugccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccgccaagaucaucuucgccgccaucccccccaacuuccccaucgacaaccucuccgccgcccagaucaccaugugcccccacgucaucgucgacguccgccagcucgagcccaucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuuccucuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcacccucaccggcuccaccucccgcgccuccgaccaggccgacacccccaccccccgccucuucaaccaccacuggcacauccagcucgacaaccucaacggcacccccuacgaccccgccgaggacauccccgccccccucggcacccccgacuuccgcggcaaggucuucggcgucgccggccagcgcaaccccgacuccaccacccgcgcccacgaggccaaggucgacaccaccuccggccgcuucacccccaagcucggcucccucgagaucaccaccgaguccgacgaccucgaccucucccagcccaccaaguucacccccgucggcaucggcgucgacaaccgcgccgaguuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcguccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccgucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14711 - RNA, 1620 nt, Artificial Sequence
  derived and/or modified sequence opt2 from capsid_protein__Norovirus__AAK96218
augaagauggccuccuccgacgccaaccccuccgacggcuccaccgccaaccucguccccgaggucaacaacgaggucauggcccucgagcccgucgucggcgccgccaucgccggccccgucgccggccagcagaacgucaucgaccccuggauccgcaacaacuucguccaggcccccggcggcgaguucaccgucucccccaccaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacgcccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgucuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgccaccaaggccaccgucuccaccggcuccguccacuucacccccaagcucggcuccguccaguacaccgccgacaccaacaacgacuuccagaccggccagaacaccaaguucacccccgucggcgucauccaggacggcuccaaccaccagaacgagccccagcaguggguccucaccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgaccccugggucaaccaguucuacacccucgcccccaugggcaacggcgccggccgccgccgcgcccucuga

SEQ ID NO: 14712 - RNA, 1623 nt, Artificial Sequence
  derived and/or modified sequence opt2 from capsid_protein__Norovirus__AAR97648
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14713 - RNA, 1623 nt, Artificial Sequence
  derived and/or modified sequence opt2 from capsid_protein__Norovirus__AAR97651
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucgucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14714 - RNA, 1623 nt, Artificial Sequence; identical to SEQ ID NO: 14712
  derived and/or modified sequence opt2 from capsid_protein__Norovirus__AAR97654

SEQ ID NO: 14715 - RNA, 1623 nt, Artificial Sequence; identical to SEQ ID NO: 14712
  derived and/or modified sequence opt2 from capsid_protein__Norovirus__AAR97657

SEQ ID NO: 14716 - RNA, 1623 nt, Artificial Sequence; identical to SEQ ID NO: 14712
  derived and/or modified sequence opt2 from capsid_protein__Norovirus__AAR97660

SEQ ID NO: 14717 - RNA, 1623 nt, Artificial Sequence
  derived and/or modified sequence opt2 from capsid_protein__Norovirus__AAR97663
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14718 - RNA, 1623 nt, Artificial Sequence
  derived and/or modified sequence opt2 from capsid_protein__Norovirus__AAS86774
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucgcccgcauguacaacggcuacgccggcggcgucgagguccagguccuccucgccggcaacgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacaacuucuuccacuacaaccagcaguccgaccagcgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucuccguccccguccucacccucaacgagcucaccaacucccgcuuccccguccccgucgacgccauguacaccucccccaacgacuccaucgucguccagccccagaacggccgcgccaccaucgacggcgagcuccucggcaccacccagcucauccccuccggcaucugcuccuuccgcggcaagaucaccacccaccucuccgacgaccgccaccucuggaacauccaggucuccaaccucaacggcacccccuucgaccccaccgacgacguccccgccccccucggcaugcccgacuucuccggccagaucuucggcgucgucucccagcgcgacaccggcaccaaccccgccaaccgcgcccacgacgccguccucgccaccuacuccgccaaguacacccccaagcucggcuccguccagaucggcaccugggacaccgacgaccuccucgagcgccagcccgucaaguucacccccgucggccucaacgagaucggccaggacaagcacuucgaccaguggguccuccccaacuacuccggcgcccucggccucaacaugcaccucgcccccgccgucuccccccucuuccccggcgagcgccuccucuucuuccgcuccuacaucccccucaagggcggccacggcgaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaaggagggcuucaucaccgucuccuccaccgagaaccgccccgucaucgucccccccaacggcuacuuccgcuucgacuccugggucaaccaguucuacucccucgcccccaugggcaccggcaacggccgccgccgcaugcaguga

SEQ ID NO: 14719 - RNA, 1623 nt, Artificial Sequence
  derived and/or modified sequence opt2 from capsid_protein__Norovirus__AAS86777
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcgucgagguccagguccuccucgccggcaacgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacaacuucuuccacuacaaccagcaguccgaccagcgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucuccguccccguccucacccucaacgagcucaccaacucccgcuuccccguccccaucgacgccauguacaccucccccaacgacuccaucgucguccagccccagaacggccgcgccaccaucgacggcgagcuccucggcaccacccagcucauccccuccggcaucugcuccuuccgcggcaagaucaccacccaccucuccgacgaccgccaccucuggaacauccaggucuccaaccucaacggcacccccuucgaccccaccgacgacguccccgccccccucggcaugcccgacuucuccggccagaucuucggcgucgucucccagcgcgacaccggcaccaaccccgccaaccgcgcccacgacgccguccucgccaccuacuccgccaaguacacccccaagcucggcuccguccagaucggcaccugggacaccgaggaccuccucgagcgccagcccgucaaguucacccccgucggccucaacgagaucggccaggacaagcacuucgaccaguggguccuccccaacuacuccggcgcccucggccucaacaugcaccucgcccccgccgucuccccccucuuccccggcgagcgccuccucuucuuccgcuccuacaucccccucaagggcggcuacggcgaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaaggagggcuucaucaccgucuccuccaccgagaaccgccccgucaucgucccccccaacggcuacuuccgcuucgacuccugggucaaccaguucuacucccucgcccccaugggcaccggcaacggccgccgccgcaugcaguga

SEQ ID NO: 14720 - RNA, 1623 nt, Artificial Sequence
  derived and/or modified sequence opt2 from capsid_protein__Norovirus__AAS86780
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuaccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacaucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcacccccuucgucccccucgagucccccgcccccgucggcuuccccgaccucggcggcugcgacuggcacgucaacuucaccuuccaggcccagaaccaggaccccucccaguccgucaccuucgccaccaacgacgccuccuucguccccuaccucggcuccaucuccccccacaacggcggcgacuuccacgccggcgacaucaucggcucccucggcuggaucuccgcccccuccgacaacacccagcucaacgucuggaccauccccaaguacggcuccucccuccccgacgucacccaccucgcccccgccgucuucccccccggcuucggcgaggucauccucuacuucuacuccaccuuccccggcuccggccagcccucccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgccgcccgccgccucggccuccgccgcaucuga

SEQ ID NO: 14721 - RNA, 1623 nt, Artificial Sequence
  derived and/or modified sequence opt2 from capsid_protein__Norovirus__AAS86783
augaugauggccuccaaggacgcccccaccucccccgacggcgccuccggcgccggccagcucguccccgaggccaacaccgccgagcagaucuccauggaccccgucgccggcgccuccaccgccgucgccaccgccggccaggucaacaugaucgaccccuggaucuucaacaacuucguccaggccccccagggcgaguucaccaucucccccaacaacacccccggcgacauccucuucgaccuccagcucggcccccaccucaaccccuuccucgcccaccucucccagauguacaacggcugggucggcaacaugcgcguccgcauccuccucgccggcaacgccuucaccgccggcaagaucaucaucugcugcgucccccccggcuucgacgcccgcauccucaccaucgcccaggccacccucuucccccaccucaucgccgacguccgcacccucgagcccgucgagcucccccucgaggacguccgcaacguccucuuccacaacuccucccagccccagcccaccaugcgccucgucgccaugcucuacaccccccuccgcaccggcggcggcuccggcggcaccgacgccuucgucgucgccggccgcguccucaccugccccgcccccgacuucuccuuccucuuccucgucccccccuccgucgagcagaagacccgcgucuucuccguccccaacgucccccucaaggaccucuccaacucccgcguccccguccccauccagggcauguucaugucccccgacgucaaccaguccguccaguuccagaacggccgcugccagaucgacggccagcuccagggcaccacccccgucucccucucccagcucugcaagauccgcggcaagaccuccuccaacgcccgcguccucaaccucuccgaggucgacggcucccccuucaucccccucgagucccccgcccccgucggcuuccccgaccucggcggcugcgacuggcacgucaacuucaccuuccaggcccaggaccaggaccccucccaguccgucaccuucgccaccaacgacgccuccuucguccccuaccucggcuccaucuccccccacaacggcggcgacuuccacuccggcgacaucaucggcucccucggcuggaucuccgcccccuccgacuccucccagcucaacgucuggaccauccccaaguacggcuccucccuccccgacgucacccaccucgcccccgccgucuucccccccggcuucggcgaggucauccucuacuucuacuccaccuuccccggcuccggccagcccguccagcuccagguccccugccuccucccccaggaguucaucacccacuucugcaacgagcaggcccccaucgccggcgaggccgcccuccuccacuacgucgaccccgacaccggccgcaaccucggcgaguucaagcucuaccccgacggcuucaugaccugcguccccaacuccgucuccuccggcccccagacccuccccaucaacggcgucuucgucuucgucuccugggucucccgcuucuaccagcucaagcccgucggcaccgccuccgucgcccgccgccucggccuccgccgcaucuga

SEQ ID NO: 14722 - RNA, 1623 nt, Artificial Sequence
  derived and/or modified sequence opt2 from capsid_protein__Norovirus__AAS86786
augaagauggccuccaacgacgccgcccccuccaacgacggcgccaccggccucguccccgagaucaacaacgagacccucccccucgagcccgucgccggcgccgccaucgccgcccccgucaccggccagaacaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgaguuccucucccccgcccagaucaccaugcucccccaccucaucgucgacguccgcacccucgagcccaucaugaucccccuccccgacguccgcaacaccuucuuccacuacaacaaccagcccgccaaccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucucccuccccauccucaccaucuccgagcucaccaacucccgcuuccccgcccccaucgacucccucuucaccgcccagaacaacaaccucaacguccagugccagaacggccgcugcacccucgacggcgagcuccagggcaccacccagcuccuccccuccggcaucugcgccuuccgcggccgccucaccgccgacgucgacggcucccacgacgaccgcuggcacaugcagcucaccaaccucaacggcacccccuucgaccccaccgaggacguccccgccccccucggcacccccgacuucaccggccuccucuucggcgucgccucccagcgcaacgucggcuccaaccccaacaccacccgcgcccacgaggccgucgucuccaccaccuccucccaguucguccccaagcucggcuccgucaacuucggcuccaccuccaccgacuuccagcuccagcagcccaccaaguucacccccgucggcaucaagaucgaguccggccacgaguucgaccagugggcccucccccgcuacuccggccaccucacccucaacaugaaccucgccccccccaucgcccccaacuuccccggcgagcagcuccucuucuuccgcuccaacguccccugcgccggcggcgucuccgacggcgucaucgacugccuccucccccaggaguggauccagcacuucuaccaggaguccgcccccucccaguccgacgucgcccucauccgcuacgucaaccccgacaccggccgcacccucuucgaggccaagcuccaccgcaccggcuacaucaccgucgcccacuccggcgacuacccccucgucguccccuccaacggcuacuuccgcuucgacuccugggucaaccaguucuacucccucgcccccaugggcaccggcaacggccgccgccgcguccaguga

SEQ ID NO: 14723 - RNA, 1623 nt, Artificial Sequence
  derived and/or modified sequence opt2 from capsid_protein__Norovirus__AAS86792
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucgcccgcauguacaacggcuacgccggcggcgucgagguccagguccuccucgccggcaacgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacaacuucuuccacuacaaccagcaguccgaccagcgcaugcgccucaucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucuccguccccguccucacccucaacgagcucaccaacucccgcuuccccguccccaucgacgccauguacaccucccccaacgacuccaucgucguccagccccagaacggccgcgccaccaucgacggcgagcuccucggcaccacccagcucauccccuccggcaucugcuccuuccgcggcaagaucaccacccaccucuccgacgaccgccaccucuggaacguccaggucuccaaccucaacggcacccccuucgaccccaccgacgacguccccgccccccucggcaugcccgacuucuccggccagaucuucggcgucgucucccagcgcgacaccggcaccaaccccgccaaccgcgcccacgacgccguccucgccaccuacuccgccaaguacacccccaagcucggcuccguccagaucggcaccugggacaccgaggaccuccucgagcgccagcccgucaaguucacccccgucggccucaacgagaucggccaggacaagcacuucgaccaguggguccuccccaacuacuccggcgcccucggccucaacaugcaccucgcccccgccgucuccccccucuuccccggcgagcgccuccucuucuuccgcuccuacaucccccucaagggcggccacggcgaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaaggagggcuucaucaccgucuccuccaccgagaaccgccccgucaucgucccccccaacggcuacuuccgcuucgacuccugggucaaccaguucuacucccucgcccccaugggcaccggcaacggccgccgccgcaugcaguga

SEQ ID NO: 14724 - RNA, 1623 nt, Artificial Sequence
  derived and/or modified sequence opt2 from capsid_protein__Norovirus__AAS86795
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucgcccgcauguacaacggcuacgccggcggcgucgagguccagguccuccucgccggcaacgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacaacuucuuccacuacaaccagcaguccgaccagcgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucuccguccccguccucacccucaacgagcucaccaacucccgcuuccccguccccaucgacgccauguacaccucccccaacgacuccaucgucguccagccccagaacggccgcgccaccaucgacggcgagcuccucggcaccacccagcucauccccuccggcaucugcuccuuccgcggcaagaucaccacccaccucuccgacgaccgccaccucuggaacauccaggucuccaaccucaacggcacccccuucgaccccaccgacgacguccccgccccccucggcaugcccgacuucuccggccagaucuucggcgucgucucccagcgcgacaccggcaccaaccccgccaaccgcgcccacgacgccguccucgccaccuacuccgccaaguacacccccaagcucggcuccguccagaucggcaccugggacaccgaggaccuccucgagcgccagcccgucaaguucacccccgucggccucaacgagaucggccaggacaagcacuucgaccaguggguccuccccaacuacuccggcgcccucggccucaacaugcaccucgcccccgccgucuccccccucuuccccggcgagcgccuccucuucuuccgcuccuacaucccccucaagggcggccacggcgaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaaggagggcuucaucaccgucuccuccaccgagaaccgccccgucaucgucccccccaacggcuacuuccgcuucgacuccugggucaaccaguucuacucccucgcccccaugggcaccggcaacggccgccgccgcaugcaguga

SEQ ID NO: 14725 - RNA, 1623 nt, Artificial Sequence
  derived and/or modified sequence opt2 from capsid_protein__Norovirus__AAS86798
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagauccuccucaaccucgagcucggccccgagcucaaccccuaccucgcccaccucgcccgcauguacaacggcuacgccggcggcgucgagguccagguccuccucgccggcaacgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacaacuucuuccacuacucccagcaguccgaccagcgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucuccguccccguccucacccucaacgagcucaccaacucccgcuuccccguccccaucgacgccauguacaccucccccaacgacuccaucgucguccagccccagaacggccgcgccaccaucgacggcgagcuccucggcaccacccagcucauccccuccggcaucugcuccuuccgcggcaagaucaccacccaccucuccgacgaccgccaccucuggaacauccaggucuccaaccucaacggcacccccuucgaccccaccgacgacguccccgccccccucggcaugcccgacuucuccggccagaucuucggcgucgucucccagcgcgacaccggcaccaaccccgccaaccgcgcccacgacgccguccucgccaccuacuccgccaaguacacccccaagcucggcuccguccagaucggcaccugggacaccgaggaccuccucgagcgccagcccgucaaguucacccccgucggccucaacgagaucggccaggacaagcacuucgaccaguggguccuccccaacuacuccggcgcccucggccucaacaugcaccucgcccccgccgucuccccccucuuccccggcgagcgccuccucuucuuccgcuccuacaucccccucaagggcggccacggcgaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaaggagggcuucaucaccgucuccuccaccgagaaccgccccgucaucgucccccccaacggcuacuuccgcuucgacuccugggucaaccaguucuacucccucgcccccaugggcaccggcaacggccgccgccgcaugcaguga

SEQ ID NO: 14726 - RNA, 1623 nt, Artificial Sequence; identical to SEQ ID NO: 14724
  derived and/or modified sequence opt2 from capsid_protein__Norovirus__AAS86801

SEQ ID NO: 14727 - RNA, 1623 nt, Artificial Sequence
  derived and/or modified sequence opt2 from capsid_protein__Norovirus__AAS86804
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaacgccuucaccgccggcaagcucgucuucgccgccauccccccccacuuccccgucgacaaccucucccccggccagaucaccauguucccccacgucaucaucgacguccgcacccucgagcccguccuccucccccuccccgacguccgcaacaacuucuuccacuacaaccagcaguccgaccagcgcaugcgccucaucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucuccguccccguccucacccucaacgagcucaccaacucccgcuuccccguccccaucgacgccauguacaccucccccaacgacuccgucgucguccagccccagaacggccgcgccaccaucgacggcgagcuccucggcaccacccagcucauccccuccggcaucugcuccuuccgcggcaagaucaccacccaccucuccgacgaccgccaccucuggaacauccaggucuccaaccucaacggcacccccuucgaccccaccgacgacguccccgccccccucggcaugcccgacuucuccggccagaucuucggcgucaucucccagcgcgacaccggcaccaaccccgccaaccgcgcccacgacgccguccucgccaccuacuccgccaaguacacccccaagcucggcuccguccagaucggcaccugggacaccgaggaccuccucgagcgccagcccgucaaguucacccccgucggccucaacgagaucggccaggacaagcacuucgaccaguggguccuccccaacuacuccggcgcccucggccucaacaugcaccucgcccccgccgucuccccccucuuccccggcgagcgccuccucuucuuccgcuccuacaucccccucaagggcggccacggcaaccccuucaucgacugccucgucccccaggaguggauccagcacuucuaccaggaguccgcccccgcccaguccuccgucgcccuccuccgcuacgucaaccccgacaccggccgcacccucuucgaggccaagcuccacaaggagggcuucaucaccgucuccuccaccgagaaccgccccgucaucgucccccccaacggcuacuuccgcuucgacuccugggucaaccaguucuacucccucgcccccaugggcaccggcaacggccgccgccgcaugcaguga

SEQ ID NO: 14728 - RNA, 1593 nt, Artificial Sequence
  derived and/or modified sequence opt2 from capsid_protein__Norovirus__AAS86807
augaugauggccuccaaggacgccaccuccaacgucgacggcgccuccggcgccggccagcucguccccgaggccaacaccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaguccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccuccaugggcaucucccccgacaacguccaguccguccaguuccagaacggccgcugcacccucgacggccgccucgucggcaccacccccgucucccucucccaggucgccaagauccgcggcaccuccaacggcaccgucaucaaccucaccgagcucgacggcacccccuuccaccccuucgagggccccgcccccaucggcuuccccgaccucggcggcugcgacuggcacgucaacaugacccaguucggccacuccucccagacccaguucgacgucgacaccacccccgagaccuucgucccccaccucggcuccauccaggccaacggcgucggcuccggcaacuacaucggcguccucuccuggaucuccccccccucccaccccuccggcucccaggucgaccucuggaagauccccaacuacggcuccuccaucaccgaggccacccaccucgcccccuccgucuucccccccggcuucggcgagguccucgucuucuucauguccaagauccccggccccggcgccuacaaccuccccugccuccucccccaggaguacaucucccacuucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccuccgcccgcggccgccucggccuccgccgcuga

SEQ ID NO: 14729 - RNA, 1623 nt, Artificial Sequence
  derived and/or modified sequence opt2 from capsid_protein__Norovirus__AAT00237
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcgccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14730 - RNA, 1623 nt, Artificial Sequence; identical to SEQ ID NO: 14729
  derived and/or modified sequence opt2 from capsid_protein__Norovirus__AAT00240

SEQ ID NO: 14731 - RNA, 1623 nt, Artificial Sequence; identical to SEQ ID NO: 14729
  derived and/or modified sequence opt2 from capsid_protein__Norovirus__AAT00243

SEQ ID NO: 14732 - RNA, 1623 nt, Artificial Sequence; identical to SEQ ID NO: 14729
  derived and/or modified sequence opt2 from capsid_protein__Norovirus__AAT00246

SEQ ID NO: 14733 - RNA, 1623 nt, Artificial Sequence
  derived and/or modified sequence opt2 from capsid_protein__Norovirus__AAT00249
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcgccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14734 - RNA, 1623 nt, Artificial Sequence
  derived and/or modified sequence opt2 from capsid_protein__Norovirus__AAT00255
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacacccgcuucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14735 - RNA, 1623 nt, Artificial Sequence; identical to SEQ ID NO: 14734
  derived and/or modified sequence opt2 from capsid_protein__Norovirus__AAT00258

SEQ ID NO: 14736 - RNA, 1623 nt, Artificial Sequence; identical to SEQ ID NO: 14734
  derived and/or modified sequence opt2 from capsid_protein__Norovirus__AAT00261

SEQ ID NO: 14737 - RNA, 1623 nt, Artificial Sequence; identical to SEQ ID NO: 14734
  derived and/or modified sequence opt2 from capsid_protein__Norovirus__AAT00264

SEQ ID NO: 14738 - RNA, 1623 nt, Artificial Sequence; identical to SEQ ID NO: 14734
  derived and/or modified sequence opt2 from capsid_protein__Norovirus__AAT00267

SEQ ID NO: 14739 - RNA, 1623 nt, Artificial Sequence; identical to SEQ ID NO: 14734
  derived and/or modified sequence opt2 from capsid_protein__Norovirus__AAT00270

SEQ ID NO: 14740 - RNA, 1623 nt, Artificial Sequence; identical to SEQ ID NO: 14734
  derived and/or modified sequence opt2 from capsid_protein__Norovirus__AAT00273

SEQ ID NO: 14741 - RNA, 1623 nt, Artificial Sequence; identical to SEQ ID NO: 14734
  derived and/or modified sequence opt2 from capsid_protein__Norovirus__AAT00276

SEQ ID NO: 14742 - RNA, 1623 nt, Artificial Sequence; identical to SEQ ID NO: 14734
  derived and/or modified sequence opt2 from capsid_protein__Norovirus__AAT00279

SEQ ID NO: 14743 - RNA, 1623 nt, Artificial Sequence; identical to SEQ ID NO: 14734
  derived and/or modified sequence opt2 from capsid_protein__Norovirus__AAT00282

SEQ ID NO: 14744 - RNA, 1623 nt, Artificial Sequence; identical to SEQ ID NO: 14734
  derived and/or modified sequence opt2 from capsid_protein__Norovirus__AAT00285

SEQ ID NO: 14745 - RNA, 1623 nt, Artificial Sequence; identical to SEQ ID NO: 14734
  derived and/or modified sequence opt2 from capsid_protein__Norovirus__AAT00288

SEQ ID NO: 14746 - RNA, 1623 nt, Artificial Sequence; identical to SEQ ID NO: 14734
  derived and/or modified sequence opt2 from capsid_protein__Norovirus__AAT00291

SEQ ID NO: 14747 - RNA, 1623 nt, Artificial Sequence; identical to SEQ ID NO: 14734
  derived and/or modified sequence opt2 from capsid_protein__Norovirus__AAT00294

SEQ ID NO: 14748 - RNA, 1623 nt, Artificial Sequence; identical to SEQ ID NO: 14734
  derived and/or modified sequence opt2 from capsid_protein__Norovirus__AAT00297

SEQ ID NO: 14749 - RNA, 1623 nt, Artificial Sequence; identical to SEQ ID NO: 14734
  derived and/or modified sequence opt2 from capsid_protein__Norovirus__AAT00300

SEQ ID NO: 14750 - RNA, 1623 nt, Artificial Sequence; identical to SEQ ID NO: 14734
  derived and/or modified sequence opt2 from capsid_protein__Norovirus__AAT00303

SEQ ID NO: 14751 - RNA, 1623 nt, Artificial Sequence; identical to SEQ ID NO: 14734
  derived and/or modified sequence opt2 from capsid_protein__Norovirus__AAT00306

SEQ ID NO: 14752 - RNA, 1623 nt, Artificial Sequence; identical to SEQ ID NO: 14734
  derived and/or modified sequence opt2 from capsid_protein__Norovirus__AAT00309

SEQ ID NO: 14753 - RNA, 1623 nt, Artificial Sequence; identical to SEQ ID NO: 14734
  derived and/or modified sequence opt2 from capsid_protein__Norovirus__AAT00312

SEQ ID NO: 14754 - RNA, 1623 nt, Artificial Sequence; identical to SEQ ID NO: 14734
  derived and/or modified sequence opt2 from capsid_protein__Norovirus__AAT00315

SEQ ID NO: 14755 - RNA, 1623 nt, Artificial Sequence; identical to SEQ ID NO: 14734
  derived and/or modified sequence opt2 from capsid_protein__Norovirus__AAT00318

SEQ ID NO: 14756 - RNA, 1623 nt, Artificial Sequence; identical to SEQ ID NO: 14734
  derived and/or modified sequence opt2 from capsid_protein__Norovirus__AAT00321

SEQ ID NO: 14757 - RNA, 1623 nt, Artificial Sequence; identical to SEQ ID NO: 14729
  derived and/or modified sequence opt2 from capsid_protein__Norovirus__AAT00324

SEQ ID NO: 14758 - RNA, 1623 nt, Artificial Sequence
  derived and/or modified sequence opt2 from capsid_protein__Norovirus__AAT00330
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccgccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14759 - RNA, 1623 nt, Artificial Sequence; identical to SEQ ID NO: 14758
  derived and/or modified sequence opt2 from capsid_protein__Norovirus__AAT00333

SEQ ID NO: 14760 - RNA, 1623 nt, Artificial Sequence; identical to SEQ ID NO: 14758
  derived and/or modified sequence opt2 from capsid_protein__Norovirus__AAT00336

SEQ ID NO: 14761 - RNA, 1623 nt, Artificial Sequence
  derived and/or modified sequence opt2 from capsid_protein__Norovirus__AAT00342
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccguccaguucaacaccgacaccaacaacgacuucgagaccggccagaacaccaaguucacccccgucggcgucguccaggacggcaacggcgcccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14762 - RNA, 1623 nt, Artificial Sequence; identical to SEQ ID NO: 14734
  derived and/or modified sequence opt2 from capsid_protein__Norovirus__AAT00345

SEQ ID NO: 14763 - RNA, 1623 nt, Artificial Sequence
  derived and/or modified sequence opt2 from capsid_protein__Norovirus__AAT00348
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacaacuacaccaugaaccucgccucccagaacuggaacaacuacgaccccaccgaggagauccccgccccccucggcacccccgacuucgucggccgcauccagggcaugcucacccagaccacccgcggcgacggcuccacccgcggccacaaggccaccgucuccaccggcgacguccacuucacccccaagcucggcuccauccaguucaacaccgacaccaacaacgacuucgagaccggccagaacacccgcuucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccacccccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14764 - RNA, 1623 nt, Artificial Sequence; identical to SEQ ID NO: 14734
  derived and/or modified sequence opt2 from capsid_protein__Norovirus__AAT00351

SEQ ID NO: 14765 - RNA, 1623 nt, Artificial Sequence; identical to SEQ ID NO: 14734
  derived and/or modified sequence opt2 from capsid_protein__Norovirus__AAT00354

SEQ ID NO: 14766 - RNA, 1623 nt, Artificial Sequence; identical to SEQ ID NO: 14734
  derived and/or modified sequence opt2 from capsid_protein__Norovirus__AAT00357

SEQ ID NO: 14767 - RNA, 1623 nt, Artificial Sequence; identical to SEQ ID NO: 14734
  derived and/or modified sequence opt2 from capsid_protein__Norovirus__AAT00360

SEQ ID NO: 14768 - RNA, 1623 nt, Artificial Sequence; identical to SEQ ID NO: 14729
  derived and/or modified sequence opt2 from capsid_protein__Norovirus__AAT00363

SEQ ID NO: 14769 - RNA, 1623 nt, Artificial Sequence; identical to SEQ ID NO: 14734
  derived and/or modified sequence opt2 from capsid_protein__Norovirus__AAT00366

SEQ ID NO: 14770 - RNA, 1623 nt, Artificial Sequence; identical to SEQ ID NO: 14734
  derived and/or modified sequence opt2 from capsid_protein__Norovirus__AAT00369

SEQ ID NO: 14771 - RNA, 1623 nt, Artificial Sequence; identical to SEQ ID NO: 14734
  derived and/or modified sequence opt2 from capsid_protein__Norovirus__AAT00372

SEQ ID NO: 14772 - RNA, 1623 nt, Artificial Sequence; identical to SEQ ID NO: 14734
  derived and/or modified sequence opt2 from capsid_protein__Norovirus__AAT00375

SEQ ID NO: 14773 - RNA, 1647 nt, Artificial Sequence
  derived and/or modified sequence opt2 from capsid_protein__Norovirus__AAT70110
augaagauggccuccaaggacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgacaacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14774 - RNA, 1623 nt, Artificial Sequence
  derived and/or modified sequence opt2 from capsid_protein__Norovirus__AAT73592
auggccuccaaggacgccgcccccuccaccgacggcgccgccggccucguccccgaguccaacaacgaggucauggcccucgagcccgucgccggcgccgcccucgccgcccccgucaccggccagaccaacaucaucgaccccuggauccgcaccaacuucguccaggcccccaacggcgaguucaccgucuccccccgcaacgcccccggcgagguccuccucaaccucgagcucggccccgagcucaaccccuaccucgcccaccucgcccgcauguacaacggcuacgccggcggcauggagguccaggucaugcucgccggcaacgccuucaccgccggcaagcucgucuucgccgccguccccccccacuuccccgucgagaaccucuccccccagcagaucaccauguucccccacgucaucaucgacguccgcacccucgagcccguccuccucccccuccccgacguccgcaacaacuucuuccacuacaaccagaaggacgaccccaagaugcgcaucgucgccaugcucuacaccccccuccgcuccaacggcuccggcgacgacgucuucaccgucuccugccgcguccucacccgccccucccccgacuucgacuucaccuaccucgucccccccaccgucgaguccaagaccaagcccuucacccuccccauccucacccucggcgagaccuccaacucccgcuuccccguccccaucgaccagauguacaccucccccaacgaggucaucuccguccagugccagaacggccgcugcacccucgacggcgagcuccagggcaccacccagcuccaggucuccggcaucugcgccuucaagggccaggucaccgcccaccuccaggacaacgagcaccucuacaacgucaccaucaccaaccucaacggcucccccuucgaccccuccgaggacauccccgccccccucggcguccccgacuucgagggccgcgucuucggcgucaucucccagcgcgacaacuacaacuccggcggccagaaccagcccgccaaccgcucccacgacgccgucguccccaccuacaccgcccaguacacccccaagcucggccagauccagaucggcaccuggcagaccgacgacaucaccgucgaccagcccgccaaguucacccccgucggccucuccgacaccgaccacuucaaccagugggucgucccccgcuacgccggcgcccucaaccucaacaccaaccucgcccccuccgucgcccccgucuuccccggcgagcgccuccucuucuuccgcuccuacaucccccucaagggcggcuucggcaaccccgccaucgacugccucgucccccaggaguggauccagcacuucuaccaggaggccacccccucccucuccgaggucgcccucguccgcuacaucaaccccgacaccggccgcgcccucuucgaggccaagcuccaccgcgccggcuucaugaccgucuccuccaacaccuccgcccccgucgucguccccgccaacggcuacuuccgcuucgacuccugggucaaccaguucuacucccucgcccccaugggcaccggcaacggccgccgccgcauccaguga

SEQ ID NO: 14775 - RNA, 1614 nt, Artificial Sequence
  derived and/or modified sequence opt2 from capsid_protein__Norovirus__AAT78480
auggccuccaaggacgccgcccccuccaacgacggcgccaccggccucguccccgagaucaacaccgagacccucccccucgagcccgucgccggcgccgccaucgccgcccccgucaccggccagaacaacaucaucgaccccuggauccgcaacaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcucccucgacggcgagcuccagggcaccacccagcuccucaccaccgccaucugcuccuaccgcggcaugaccuccaaccccacccgcgacuacugggacggccaccuccuccaccucguccaccccaacggcgccaccuacgaccccaccgaggacguccccgcccccuucggcacccaggacuuccgcggcauccucuacggcguccucacccagaacccccgcgccuccggcgacgaggccgccaacucccagggcgucuacaucuccuccaccuccgagaaguucacccccaagcucggcaccaucggccuccaccagguccagggccaccacucccagcaccagcaguccaaguucaccccccucggcgucgccgucaacggcaacacccccuuccgccagugggagcuccccaacuacuccggcgcccucacccucaacaccaaccucgcccccgccgucggccccaacuuccccggcgagcagauccucuucuuccgcuccaacguccccuccguccagggcggccagcccaucgagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacuccugggucaaccaguucuacgcccucgcccccaugggcaccggcaacggccgccgccgcauccaguga

SEQ ID NO: 14776 - RNA, 1635 nt, Artificial Sequence
  derived and/or modified sequence opt2 from capsid_protein__Norovirus__AAT78481
auggccuccaaggacgcccccuccaacauggacggcaccuccggcgccggccagcucguccccgaggccaacaccgccgaccccaucccccucgagcccgucgucggcgccgccaccgccgccgccaccgccggccaggucaacaugaucgaccccuggaucaugaacaacuucguccagucccccgagggcgaguucaccaucucccccaacaacacccccggcgacauccucuucgaccuccagcucggcccccaccucaaccccuuccuccagcaccucucccagauguacaacggcugggucggcaacaugcgcguccgcauccuccucgccggcaacgccuucuccgccggcaagaucaucaucugcugcgucccccccggcuucaccgcccagaacaucuccaucgcccaggccaccauguucccccacgucaucgccgacguccgcguccucgagcccaucgagaucccccucgacgacguccgcaacguccucuuccacaccaacgagaaccgccccaccaugcgccuccucugcaugcucuacaccccccuccgcgccggcggcgccuccgccggcaccgaccccuucgucaucgccggccgcguccucaccugccccucccccgacuucaacuuccucuuccucgucccccccuccgucgagcagaagacccgccagcucaccguccccaacaucccccucaacaaccucuccaacuccuccguccccgccaugaucaacaagauggccaucuccuccgacgccaaccaggucguccaguuccagaacggccgcugcaccaccgacggccagcuccucggcaccacccccaucuccgccucccaggucgcccgcauccgcggcaaggucuucuccaccuccuccggcaagggccucaaccucuccgagcucgacggcucccccuaccacgccuucgagucccccgcccccgucggcuuccccgaccucggccacugcgacuggcacgucuccuccuucaaggccgaccagaacuccuccggcgaccccaucucccgccucgacaucaagcagggcgccuccuucgccccccaccucggcuccaucgaguacaccaccucccagaaccccgacggcggccagcucggcacccucaccuggaucuccucccccuccgacgacacccccggccacggcaccaucaaccucuggaagauccccuccuacggcuccaccgucaccgaguccguccaccucgccccccccaucuacccccccggcuucggcgagacccucgucaaccucauguccaacuuccccaucggccacaccaacuccaacauggcccagguccccugcacccucccccaggaguucgucgcccacuucgucaacgagcaggcccccguccgcggcgacgccgcccuccuccacuacgucgaccccgacacccaccgcaaccucggcgaguucaagcucuaccccgagggcuacaucaccugcguccccaacaccggcggcggcggcccccagucccuccccaccaacggcgucuucaucuucuccuccugggucucccgcuacuaccagcucgagcccgucggcaccgccggccccgcccgccgccucggcguccgccgcgucuga

SEQ ID NO: 14777 - RNA, 1620 nt, Artificial Sequence
  derived and/or modified sequence opt2 from capsid_protein__Norovirus__AAU95776
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccucaaggccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 14778 - RNA, 1644 nt, Artificial Sequence
  derived and/or modified sequence opt2 from capsid_protein__Norovirus__AAX32874
augaagauggccuccaacgacgccgcccccuccaccgacggcuccgccggccucguccccgaggucaacaacgagaccauggcccucgagcccgucgucggcgccccccucgccgcccccgucgccggccagcacaacaucaucgaccccuggaucaagaugaacuucguccaggcccccaacggcgaguucaccgucuccccccgcaacgcccccggcgagauccuccucgaccucgagcucggccccgaccucaaccccuaccucucccaccucgcccgcauguacaacggcuacgccggcggcauggagguccaggucguccucgccggcaacgccuucaccgccggcaagaucaucuucgccgccgucccccccaacuuccccgccgagaaccucuccgccgcccaggucaccaugugcccccacgucaucgucgacguccgccagcucgagcccgucaugcuccccaugcccgacauccgcaacaagcucuuccacuacaaccaggucgacgaccccaagcuccgccuccucgccuaccucuacaccccccuccgcgccaacaacgccggcgacgacgucuucaccgucuccugccgcguccucacccgccccacccccgacuucgaguucauguuccucgucccccccaccgucgaguccaagaccaagcccuucucccuccccucccucacccucgacgagcucuccaacucccgcuuccccgcccccaucguccagcucuacaccaacccccacgacaaccucgucguccagccccagaacggccgcugcaccaucgacggccuccuccagggcaccacccagcucgucuccugcaacgucugcuccuuccgcggcaccaucggcgacggccagcccgccucccacuccgaggaggagaucaugcccauggccuucaacauccagcgcgagaucaugcucgagaaccucgacggcucccccuacgaccccgccgacgacauccccgccguccucggcucccccgacuuccagggcaucgucuucggcguccucucccagcgcaacgccgacggccagacccgcgcccacgaggccaaggucgacacccgcgccgcccgcuucgcccccaagcucggcuucgucgucgccaccgucgaguccaccgacuuccacgccaaccagcccucccgcuucacccccgucggccucggcggcgacggcaaccaggacuucaaccagugggcccuccccgccuacggcggcgcccucaccaacaacaccaaccucgccccccccgucaugcccgucuaccccggcgagcagauccucuacuuccgcucccagcuccccuccuccggcggcgucgucggcggcuggcucgacugccuccucccccaggaguggguccagcacuucuuccaggaguccgccaccucccaguccgacgucgcccucguccgcuacaucaaccccaccaccggccgcguccucuucgaggccaagcuccacaagcagggcuuccucaccgucgccgccuccggcuccuacccccucgucguccccgccgacggcuacuuccgcuucgaguccugggucaaccaguucuacacccucgcccccaugggcaacggcuccggccgccgccgcacccgcuga

SEQ ID NO: 14779 - RNA, 1674 nt, Artificial Sequence
  derived and/or modified sequence opt2 from capsid_protein__Norovirus__AAX32877
augaugauggccuccaacgacgccaccgcccccaccgacggcgccgccggccucguccccgaggucaccaacgagaccauggcccucgagcccgucgccggcgccgcccucgccgcccccgucgucggccagcacaacgucaucgaccccuggauccgcggcaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucguccucgccggcaacgccuucgccgccggcaagaucaucuucgccgccgucccccccuccuuccccgucgacgcccucuccgcccccaccaucaccaugugcccccacgucaucgucgacguccgccagcucgagcccguccuccuccccaugcccgacguccgcaacaacuucuuccacuacaaccaguccuccgaccccaagcuccgccucgucgccaugcucuacaccccccuccgcgccaacucccccaccgacgacgucuucaccgucuccugccgcguccucacccgccccucccccgacuucgaguucaccuuccucaucccccccaccgucgaguccaaguccaagcccuucaccaucccccagcucacccucuccgagcucuccaacucccgcuuccccgcccccaucgacaugcucuacaccucccccaacgacaacaucgucguccagccccagaacggccgcugcacccucgacggcgagcuccagggcaccacccagcuccagcccucccucaucugcuccuuccgcggcgucacccucaacgagaccucccgcaugcucgucgaccaggaggaggaggaggagggcgagguccagcgcccccaggcccgcgccuucaaccacgaguaccaccuccagcuccagaaccucgacggcaccgacuacgaccccgccggcgaccuccccgccacccucggcgcccccgacuucaucggcaccgucuacggcgucgucucccagcgcaccacccgcgacuccgccgcccgcgcccacgaggccaagaucaccaccuccgacccccgcuacgcccccaagcucggcuccgucgaguucgucaccgaguccaccgacaucguccucaacgaccagaccaaguucacccccgucggccucgcccacaaccgcgccgucgacuacaagcagugggagcucccccacuacgccggcgagcucaccgccaacaccaaccucgccccccccgucgcccccgucuaccccggcgagcagcuccucuucuuccgcuccaaccucccccucgccggcggcaccgccgccuccguccucgacugccuccucccccaggaguggauccagcacuucuaccaggaguccuucgccccccaguccgacaucgcccuccuccgcuacgucaaccccgacaccggccgcguccucuucgaggccaagcuccaccgccagggcuacaucaccgucgccggcgccggcaccucccccgucgccgucccccccaacggcuacuuccgcuucgaguccugggucucccaguucuacacccucgcccccaugggcuccggcaccggccgccgccgcaaccaguga

SEQ ID NO: 14780 - RNA, 1674 nt, Artificial Sequence
  derived and/or modified sequence opt2 from capsid_protein__Norovirus__AAX32880
augaugauggccuccaacgacgccaccgcccccaccgacggcgccgccggccucguccccgaggucaccaacgagaccauggcccucgagcccgucgccggcgccgcccucgccgcccccgucgucggccagcacaacgucaucgaccccuggauccgcggcaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucguccucgccggcaacgccuucgccgccggcaagaucaucuucgccgccgucccccccuccuuccccgucgacgcccucuccgcccccaccaucaccaugugcccccacgucaucgucgacguccgccagcucgagcccguccuccuccccaugcccgacguccgcaacaacuucuuccacuacaaccaguccuccgaccccaagcuccgccucgucgccaugcucuacaccccccuccgcgccaacucccccaccgacgacgucuucaccgucuccugccgcguccucacccgccccucccccgacuucgaguucaccuuccucaucccccccaccgucgaguccaaguccaagcccuucaccaucccccagcucacccucuccgagcucuccaacucccgcuuccccgcccccaucgacaugcucuacaccucccccaacgacaacaucgucguccagccccagaacggccgcugcacccucggcggcgagcuccagggcaccacccagcuccagcccucccucaucugcuccuuccgcggcgucacccucaacgagaccucccgcaugcucgucgaccaggaggaggaggaggagggcgagguccagcgcccccaggcccgcgccuucaaccacgaguaccaccuccagcuccagaaccucgacggcaccgacuacgaccccgccggcgaccuccccgccacccucggcgcccccgacuucaucggcaccgucuacggcgucgucucccagcgcaccacccgcgacuccgccgcccgcgcccacgaggccaagaucaccaccuccgacccccgcuacgcccccaagcucggcuccgucgaguucgucaccgaguccaccgacaucguccucaacgaccagaccaaguucacccccgucggccucgcccacaaccgcgccgucgacuacaagcagugggagcucccccacuacgccggcgagcucaccgccaacaccaaccucgccccccccgucgcccccgucuaccccggcgagcagcuccucuucuuccgcuccaaccucccccucgccggcggcaccgccgccuccguccucgacugccuccucccccaggaguggauccagcacuucuaccaggaguccuucgccccccaguccgacaucgcccuccuccgcuacgucaaccccgacaccggccgcguccucuucgaggccaagcuccaccgccagggcuacaucaccgucgccggcgccggcaccucccccgucgccgucccccccaacggcuacuuccgcuucgaguccugggucucccaguucuacacccucgcccccaugggcuccggcaccggccgccgccgcaaccaguga

SEQ ID NO: 14781 - RNA, 1647 nt, Artificial Sequence
  derived and/or modified sequence opt2 from capsid_protein__Norovirus__AAX32886
augaagauggccuccuccgacgccgcccccuccuccgacggcuccgccggccucguccccgaggucaacuccgagaccauggcccucgagcccgucgucggcgccccccucgccgcccccgucgccggccagcacaacaucaucgaccccuggaucaagcucaacuucguccaggcccccaacggcgaguucaccgucuccccccgcaacgcccccggcgagauccuccucgaccucgagcucggccccgaccucaaccccuaccucgcccaccucucccgcauguacaacgccuacgccggcggcauggagguccaggucauccucgccggcaacgccuucaccgccggcaagaucaucuucgccgccgucccccccaacuucccccucgagaaccucuccgccgcccagaucaccaugugcccccacaucaucgucgacguccgccagcucgagcccgucaugcuccccaugcccgacguccgcaaccgccucuuccacuacaaccagguccgcgagccccgccuccgccucgucgccuaccucuacaccccccuccgcgccaacaacgccggcgacgacgucuucaccgucuccugccgcguccucacccgccccucccaggacuucgaguucauguuccucgucccccccuccgucgaguccaagaccaagcccuucucccuccccaaccucacccucgccgagcucuccaacucccgcuucccccuccccaucgagcagcucuacaccaacccccucgacaaccucgucguccagccccagaacggccgcugcaccaucgacggcauccuccucggcaccacccagcucguccccucccucaucugcuccaugcgcggcacccucgaggccgaccaggccuccggccacaccgacgacgaguccguccagucccgcgccuucaaccgccagcgcucccucaugcucgagaaccccgacggcuccgccuucgaccccuccgacgagguccccgccguccucggcguccccgacuuccgcggcgucgucuucggcguccucucccagcgcaacaacggcgacaccacccgcucccacgaggccaagaucgacacccgccgcccccgcuacgcccccaagcucggcuucgucgagguccucaccgaguccgacgacuuccagaacggcccccccaccaaguucacccccgucggccucggcggcgacggcaaccccgacuuccagcagugggcccuccccgacuacggcggcgcccucaccaacaacaccaaccucgccccccccgucguccccgucuaccccggcgagcagauccucuucuuccgcucccagcuccccuccuccggcggcaccgucgccggcuggcucgacugccuccucccccaggaguggauccagcacuucuaccaggacuccgccgccgcccaguccgacgucgcccucguccgcuacaucaaccccgccaccggccgcguccucuucgaggccaagcuccaccgccagggcuuccucaccgucuccgccgccggcccccaccccgucgucgcccccgccgacggcuacuuccgcuucgaguccugggucaaccaguucuacacccucgcccccaugggcaacggcuccggccgccgccgcgucuacuga

SEQ ID NO: 14782 - RNA, 1623 nt, Artificial Sequence
  derived and/or modified sequence opt2 from capsid_protein__Norovirus__AAZ31376
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagguccucucccccucccaggucaccauguucccccacaucaucgucgacguccgccagcucgagcccguccucaucccccuccccgacguccgcaacaaccucuaccacuacaaccaguccaacgaccccaccauccgccucaucgccaugcucuacaccccccuccgcgccaacaacgccggcgacgacgucuucaccgucuccugccgcguccucacccgccccucccccgacuucgacuucauguuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcgcccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccuggaucaaccaguucuacacccucgcccccaugggcaacggcgccggccgccgccgcgcccucuga

SEQ ID NO: 14783 - RNA, 1623 nt, Artificial Sequence
  derived and/or modified sequence opt2 from capsid_protein__Norovirus__AAZ31396
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagguccucucccccucccaggucaccauguucccccacaucaucgucgacguccgccagcucgagcccguccucaucccccuccccgacguccgcaacaaccucuaccacuacaaccaguccaacgaccccaccauccgccucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggccgcauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14784 - RNA, 1623 nt, Artificial Sequence
  derived and/or modified sequence opt2 from capsid_protein__Norovirus__AAZ31402
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucggccccucccaggucaccauguucccccacaucaucgucgacguccgccagcucgagcccguccucaucccccuccucgacguccgcaacaaccucuaccacuacaaccaguccaacgaccccaccaucaagcucaucgccaugcucuacaccccccuccgcgccaacaacgccggcgaggucgucuucaccgucuccugccgcguccucacccgccccucccccgacuucgacuucaucuuccucgucccccccaccgucgagucccgcaccaagcccuucaccguccccauccucaccgccgaggagaugaccaacucccgcuuccccaccccccucggcaagcucuucaccggccccuccuccgccuucgucguccagccccagaacggccgcugcgccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcggcguccaguucaccaccgacaccaacaacgacuucgagaccggccagaacaccaaguucacccccgucggcgucauccaggacggcaacuccacccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacgccggccgcguccucuucgagugcaagccccacaaguccggcuacgucaccgucgcccacaccggccagcacgaccucgucaucccccccaacggcuacuuccgcuucgacuccugggucaaccaguucugcacccucgcccccaugggcaacggcaccggccgccgccgcgcccucuga

SEQ ID NO: 14785 - RNA, 1620 nt, Artificial Sequence
  derived and/or modified sequence opt2 from capsid_protein__Norovirus__AAZ31411
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccccucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgaccccguccucauccccucccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaucaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccaggacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccagcccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 14786 - RNA, 1647 nt, Artificial Sequence
  derived and/or modified sequence opt2 from capsid_protein__Norovirus__AAZ31423
augaagauggccuccuccgacgccacccccuccaacgacggcgccgccggccucguccccgagaucgacaacgaggccauggcccucgaccccgucgccggcgccgccaucgccgccccccucaccggccagcagaacaucaucgaccucuggaucaugaacaacuucguccaggcccccggcggcgaguucaccgucuccccccgcaacucccccggcgagguccuccucaaccucgagcucggccccgagaucaaccccuaccucgcccaccucgcccgcaugcacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccucaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccgcgaggccgacuuccagcaguggucccuccccgacuacuccggccaguucacccacaacaugaaccucgcccccgccgucgcccccaaccuccccggcgagcagcuccucuucuuccgcucccagcuccccuccuccggcggccgcuccaccggcauccucgacugccucgucccccaggaguggguccagcacuucuaccaggaguccgcccccgcccagacccaggucgcccucguccgcuacaucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcuccggccgccgccgcauccaguga

SEQ ID NO: 14787 - RNA, 1623 nt, Artificial Sequence
  derived and/or modified sequence opt2 from capsid_protein__Norovirus__AAZ31428
augaagauggccuccaacgacgccgcccccuccaacgacggcgccgccggccucguccccgagaucaacaacgaggucaugccccucgagcccgucgccggcgccucccucgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccaccccuccggcauggaggagcagaucguccucgccggcaacgccuucaccgccggcaagaucaucuucgccgccaucccccccggcuuccccuacgagaaccucucccccucccacaugaccaugugcccccacgucaucaucuacgucauccagcucgagcccguccucaugcucaugcccgagauccagaacaacuucuuccacuacaaccagggcaacgaccccaagcuccgccucgucgccaugcucuacaccccccuccgcgccaacaacuccggcgacgacgucuucaccgucuccugccgcguccucaccaagcccucccccgacuucgaguucaccuuccucgucccccccaccgucgaguccaagaccaaggaguucacccuccccauccuccgcaucuccgagaugaccaacucccgcuuccccguccccgucgagaugauguacaccgcccgcaacgagaaccaggucguccagccccagaacggccgcgucacccucgacggcgagcuccucggcaccaccccccuccucgccgucaacaucugcaaguucaagggcgaggucaucgccaagaacggcgacguccgcuccuaccgcauggacauggagaucaccaacaccgacggcacccccaucgaccccaccgaggacacccccggccccaucggcucccccgacuuccagggcauccucuucggcgucgccucccagcgcaacaagaacgagcagaaccccgccacccgcgcccacgaggucaacaucaacaccggcggcgaccaguacgcccccaagcucgcccaggucaaguucuucuccgagucccaggacuucgagguccaccagcccaccgucuucacccccgucggcgucgccggcgacaccucccaccccuuccgccaguggguccucccccgcuacggcggccaccucaccaacaacacccaccucgcccccgccgucgccccccucuuccccggcgagcagauccucuucuuccgcucccagauccccuccuccggcggccacgagcucggcuacauggacugccucgucccccaggaguggguccagcacuucuaccaggaggccgccaccgcccaguccgaggucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcguccaguga

SEQ ID NO: 14788 - RNA, 1626 nt, Artificial Sequence
  derived and/or modified sequence opt2 from capsid_protein__Norovirus__ABB02420
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggccaggucgccaccuucaccaugaucgagcaggacggcuccgccuacguccccggcgaccgcgccgccccccucggcuaccccgacuacuccggccagcucgagaucgagguccagaccgagaccaccaaggccggcgacaagcucaaggucaccaccuucgagaugauccucggccccaccaccaacgucgaccaggcccccuaccagggccgcgccuacgccucccucaccgccgucgccucccucgaccucgucgacggccgcguccgcgccgucccccgcuccaucuacuccuuccaggacguccuccccgaguacaacgacggccuccucgucccccucgcccccccccucggccccuuccuccccggcgagguccuccuccgcuuccgcaccuacaugcgccagcucgacaccgccgacgccgccgcccagcccaucgacugcgcccucccccaggaguucaucuccugguucgccuccaacuccuucaccguccaguccgacgcccuccucguccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14789 - RNA, 1626 nt, Artificial Sequence
  derived and/or modified sequence opt2 from capsid_protein__Norovirus__ABB02423
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccuccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucaccaugaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggccgcgccuacgccucccucaccgccgccgccucccucgaccucgucgacggccgcguccgcgccgucccccgcuccgucuacuccuuccaggacgagcuccccgaguacaacgacggccuccucgucccccucgcccccccccucggccccuuccuccccggcgagguccuccuccgcuuccgcaccuacaugcgccagcucgacaccgccgacgccuccgcccagcccaucgacugcgcccucccccaggaguucaucuccugguucgccuccaacaacuucaccguccaguccgacgcccuccucguccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgucaccggccgcacccucaagcaguga

SEQ ID NO: 14790 - RNA, 1623 nt, Artificial Sequence
  derived and/or modified sequence opt2 from capsid_protein__Norovirus__ABC96746
augaagauggccuccaacgacgccuccuccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucaccaccgacaccaacaacgacuucgagaccggccagaacaccaaguucacccccgucggcgucguccaggacggcaacuccacccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14791 - RNA, 1620 nt, Artificial Sequence
  derived and/or modified sequence opt2 from capsid_protein__Norovirus__ABD77588
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacuccuccguccaggcccccggcggcgaguucaccgucuccccccgcgacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgccccccccaacuuccccaccgagggccucucccccucccaggucaccauguucccccacaucaucgucggcguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaacugcucccgcguccccgccgucccccucuccuccaaccacaagaugcagugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14792 - RNA, 1623 nt, Artificial Sequence
  derived and/or modified sequence opt2 from capsid_protein__Norovirus__ABD77589
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucgacuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14793 - RNA, 1647 nt, Artificial Sequence
  derived and/or modified sequence opt2 from capsid_protein__Norovirus__ABD77590
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacuccaagcuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucuccguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccacgaggagaacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14794 - RNA, 1626 nt, Artificial Sequence
  derived and/or modified sequence opt2 from capsid_protein__Norovirus__ABG45845
augcgcauguccgacggcgccgcccccaaggccaacggcuccgaggccuccggccaggaccucguccccaccgccgucgagcaggccguccccauccagcccgucgccggcgccucccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccgccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaccgucaccaccuucgagaugauccucggccccaccaccaacgucgaccaggcccccuuccagggccgcgccuacgccucccucaccgccgccgccucccucgaccucgucgacggccgcguccgcgccgucccccgcuccaucuacuccuuccaggacgucauccccgaguacaacgacggccuccucgucccccucgccccccccaucggccccuuccuccccggcgagguccuccuccgcuuccgcaccuacaugcgccagaucgacuccuccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 14795 - RNA, 1626 nt, Artificial Sequence
  derived and/or modified sequence opt2 from capsid_protein__Norovirus__ABG45847
augcgcauguccgacggcgccgcccccaaggccaacggcuccgaggccuccggccaggaccucguccccaccgcccucgagcaggccguccccauccagcccgucgccggcgccucccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccgccaacccccaguggcagaacggccgcguccacgucgacggcacccuccucggcaccacccccgucuccggcuccugggucuccugcuucgccgccgaggccgccuacgaguuccaguccggcaccggcgaggucgccgccuucacccucaucgagcaggacggcuccgccuacguccccggcgaccgcgccgccccccucggcuaccccgacuucuccggccagcucgagaucgagguccagaccgagaccaccaagaccggcgacaagcucaccgucaccaccuucgagaugauccucggccccaccaccaacgucgaccaggcccccuuccagggccgcgucuacgccucccucaccgccgccgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccagaucgacuccuccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 14796 - RNA, 1626 nt, Artificial Sequence
  derived and/or modified sequence opt2 from capsid_protein__Norovirus__ABG45849
augcgcauguccgacggcgccgcccccaaggccaacggcuccgaggccuccggccaggaccucguccccaccgccgucgagcaggccguccccauccagcccgucgccggcgccucccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuucccccgcggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucggccccucccuccccgccaacccccaguggcagaacggccgcguccacgucgacggcacccuccucggcaccacccccgucuccggcuccugggucuccugcuucgccgccgaggccgccuacgaguuccaguccggcaccggcgaggucgccgccuucacccucaucgagcaggacggcuccgccuacguccccggcgaccgcgccgccccccucggcuaccccgacuucuccggccagcucgagaucgagguccagaccgagaccaccaagaccggcgacaagcucaccgucaccaccuucgagaugauccucggccccaccaccaacgucgaccaggcccccuuccagggccgcgucuacgccucccucaccgccgccgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccagaucgacuccuccgacgccgccgccgaggccaucgacugcgcccucccccaggaguucaucuccugguucgccuccaacgccuucaccguccaguccgaggcccuccuccuccgcuaccgcaacacccucaccgagcagcuccucuucgagugcaagcucuacuccgagggcuacaucgcccucuccuacuccggcuccggcccccucaccuuccccaccgacggcuucuucgaggccgucuccugggucccccgccucuaccagcucgccuccgucggcucccucgccaccggccgcacccucaagcaguga

SEQ ID NO: 14797 - RNA, 1626 nt, Artificial Sequence
  derived and/or modified sequence opt2 from capsid_protein__Norovirus__ABG45851
augcgcauguccgacggcgccgcccccaaggccaacggcuccgaggccuccggccaggaccucguccccaccgccgucgagcaggccguccccauccagcccgucgccggcgccucccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgccgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccgccaacccccaguggcagaacggccgcguccacgucgacggcacccuccucggcaccacccccgucuccggcucccgcgucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaccgucaccaccuucgagaugauccucggccccaccaccaacgucgaccaggcccccuuccagggccgcgccuacgccucccucaccgccgccgccucccucgaccucgucgacggccgcguccgcgccgucccccgcuccaucuacuccuuccaggacgucauccccgaguacaacgacggccuccucgucccccucgccccccccaucggccccuuccuccccggcgagguccuccuccgcuuccgcaccuacaugcgccagaucgacuccuccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 14798 - RNA, 1626 nt, Artificial Sequence
  derived and/or modified sequence opt2 from capsid_protein__Norovirus__ABI95835
augcgcauguccgacggcgccgcccccaaggccaacggcuccgaggccuccggccaggaccucguccccaccgccgucgagcaggccguccccauccagcccgucgccggcgccucccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccgccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaccgucaccaccuucgagaugauccucggccccaccaccaacgucgaccaggcccccuuccagggccgcgccuacgccucccucaccgccgccgccucccucgaccucgucgacggccgcguccgcgccgucccccgcuccaucuacuccuuccaggacgucauccccgaguacaacgacggccuccucgucccccucgccccccccaucggccccuuccuccccggcgagguccuccuccgcuuccgcaccuacaugcgccagaucgacuccuccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaucuuccccaccgacggcuucuucgaggucgucuccugggucccccgccucuaccagcucgccuccgucggcucccucgccaccggccgcacccucaagcaguga

SEQ ID NO: 14799 - RNA, 1620 nt, Artificial Sequence
  derived and/or modified sequence opt2 from capsid_protein__Norovirus__ABI97981
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcaccuacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 14800 - RNA, 1626 nt, Artificial Sequence
  derived and/or modified sequence opt2 from capsid_protein__Norovirus__ABP99038
augcgcauguccgacggcgccgcccccaaggccaacggcuccgaggccuccggccaggaccucguccccaccgccgucgagcaggccguccccauccagcccgucgccggcgccucccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgcccuccagccccgccucugcacccacgcccgcuggcccgcccccgucuacggccuccucgucgaccccucccuccccuccuccccccaguggcagaacggccgcguccacgucgacggcacccuccucggcaccacccccgucuccggcuccugggucuccugcuucgccgccgaggccgccuacgaguuccaguccggcaccggcgaggucgccaccuccacccucaucgagcaggacggcuccgccuacguccccggcgagcgcgccgccccccucggcuaccccgacuucuccggccagcucgagaucgagguccagaccgagaccaccaaggccggcgacaagcuccgcgucaccaccuucgagaugauccucggccccaccaccaacgucgaccaggcccccuaccagggccgcgucuacgccucccucaccgccgccgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccagaucgacuccuccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucgccuuccccaccgacggcuucuucgaggucgucuccugggucccccgccucuaccagcucgccuccgucggcucccucgccaccggccgcacccucaagcaguga

SEQ ID NO: 14801 - RNA, 1626 nt, Artificial Sequence
  derived and/or modified sequence opt2 from capsid_protein__Norovirus__ABP99041
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucaccaugaucgagcaggacggcuccgccuacguccccggcgaccgcgccgccccccucggcuaccccgacuucuccggccagcucgagaucgagguccagaccgagaccaccaaggccggcgacaagcucaaggucaccaccuucgacaugauccucggccccaccaccaacgucgaccaggcccccuaccagggccgcgccuacgccucccucaccgccgccgccucccucgaccucgucgacggccgcguccgcgccgucccccgcuccaucuacuccuuccaggacgagcuccccgaguacaacgacggccuccucgucccccucgcccccccccucggccccuuccuccccggcgagguccuccuccgcuuccgcaccuacaugcgccagcucgacaccgccgacgccuccgcccagcccaucgacugcgcccucccccaggaguucaucuccugguucgccuccaacaacuucaccguccaguccgacgcccuccucguccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14802 - RNA, 1623 nt, Artificial Sequence
  derived and/or modified sequence opt2 from capsid_protein__Norovirus__ABQ12784
augaagauggccuccaacgacgccacccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccuccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccaccccccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14803 - RNA, 1737 nt, Artificial Sequence
  derived and/or modified sequence opt2 from capsid_protein__Norovirus__ABR15783
augaagauggccuccuccgacgccacccccuccuccgacggcgccggcaaccucguccccgagucccagcaggagguccucccccucgcccccgucgccggcgccgcccucgccgcccccgucgucggccagcagaacaucaucgaccccuggaucaaggagaacuucguccaggccccccagggcgaguucaccgucucccccaagaacucccccggcgagguccucgucaaccucgagcucuccccccgccucaaccccuaccuccaccaccucuccaagauguacaacgccuacgccggcggcauggaggucgagaucauccucgccggcaacgccuucaccgccggcaagguccucaucgccgccgucccccccaacuuccccaucgagaacgucuccgccucccaggccucccaguucccccacgucaucgucgacguccgcacccucgagcccauccgccucccccuccccgacguccgcaccaacuucuuccacuacaccacccaggaggagccccgcaugcgcaucgucgccuggcucuacaccccccuccgcaccaacggcuccggcgacgacuccuucaccgucuccggccgcauccucacccgccccucccccgacuucgaguucuccuuccucgucccccccaccgucgagaccaagaccgucuccuucuccguccccggccucgucguccaggacauguccaacucccgcuggcccgcccagaucuccggccucgucguccgcggcaacgaggcccaggucguccacuuccagaacggccgcugcaccaccgagggcaugcuccucggcaccaccacccucaacaucaacuccaucugcggccuccgcggccucuccgucucccaggccuccguccgcggcgcccccgcccucaccgaggagaugcccccccucgaggacgaggucgccgacggcgccgccgccaccuacacccucacccgcgccgccgacaccgcccucuggcuccgcgucgaggagcccgacggccgccccuacgacaucuucggcgaccagcccgccccccucggcacccccgacuucaccgccgucaucgucggcaccgccauccgcccccgcaccaccuccggcgccuaccuccacgacgccuacgucgacaccacccccggcgacgccgacuucacccccuccaccggcaacaccaagaucguccuccgcggcggcggcuccggccacgucggccagggccacuacuggcaguucaagcccaucgccgucgagggcggcggcucccgcccccaguaccaggaguacaaccuccccgacuacgccggccccaccgccuccaaccacgaccucgccccccccgucgccccccgcaugcccggcgagcuccuccuccucuucgaguccgacaugcccgucugggacaacggcgccggcgccgcccccgcccagaagauccacugccuccuccccaacgaguucaucacccaccucuucgaccuccaggcccccgcccucgccgaggccgcccuccuccgcuacguccaccccgacuccggccgcacccucuucgagugcaagcucuaccgcgagggcuacauggucgucgccgcccccgucggccgccucaacuucccccucgacggcuacuuccgcuucgacuccugggucuccgccuucuacguccucucccccgucggcuccggccagggccgccgcggccgcuccaaggccgccuga

SEQ ID NO: 14804 - RNA, 807 nt, Artificial Sequence
  derived and/or modified sequence opt2 from capsid_protein__Norovirus__ABR24136
auggccggcgccuucuucgccggccucgccuccgacguccucggcuccggccucggcucccucaucaacgccggcgccggcgccaucaaccagaaggucgaguucgagaacaaccgcaagcuccagcaggccuccuucgaguucuccuccaaccuccagcaggccuccuuccagcacgacaaggagaugcuccaggcccagaucgaggccaccaagaagcuccagcagggcaugaugaaggucaagcaggccaugcuccucgagggcggcuucuccgagaccgacgccgcccgcggcgccaucaacgcccccaugaccaaggcccucgacugguccggcacccgcuacugggcccccgacgcccgcaccaccaccuacaacgccggccgcuucuccaccccccagcccuccggcgcccuccccggccgcaccaacccccgcgccaccguccccgcccgcggcucccccuccacccccuccaacaccuccaccgucaccuccgucuacuccgaccagaccgucuccacccgccucggcuccaccgccggcuccggcacccgcgucuccucccuccccuccaccgcccgcacccgcuccugggucgaggaccagaaccgcaaccucucccccuucaugcgcggcgcccacaacaucuccuucgucaccccccccgccucccgcuccuccucccagggcaccgucuccaccguccccaaggagguccucgacuccuggaccggcgccuucaacacccgccgccagccccucuucgcccacauccgcaagcgcggcgagucccgcgccuga

SEQ ID NO: 14805 - RNA, 1647 nt, Artificial Sequence
  derived and/or modified sequence opt2 from capsid_protein__Norovirus__ABS12173
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgccccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14806 - RNA, 1611 nt, Artificial Sequence
  derived and/or modified sequence opt2 from capsid_protein__Norovirus__ABS12175
augaagauggccuccaacgacgccacccccuccgacgacggcgccgccggccucguccccgagaucaacuccgaggucauggcccucgagcccgucgccggcgccucccucgccgcccccgucgucggccagcagaacaucaucgaccccuggauccgcaacaacuucguccaggcccccgccggcgaguucaccgucuccccccgcaacucccccggcgagcuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgccaucccccccuccuuccccuacgagaaccucucccccgcccagcucaccaugugcccccacgucaucgucgacguccgccagcucgagcccguccuccuccccaugcccgacauccgcaacgucuucuaccacuacaaccagaacaacucccccaagcuccgccucgucgccaugcucuacaccccccuccgcgccaacaacuccggcgacgacgucuucaccgucuccugccgcguccucacccgccccucccccgacuuccaguucaccuuccucgucccccccaccgucgaguccaagaccaagaacuucacccuccccguccuccgcgucuccgagaugaccaacucccgcuuccccgucguccucgaccagauguacaccucccgcaacgagaacaucaucguccagccccagaacggccgcugcaccaccgacggcgagcuccucggcaccaccauccuccaguccgucuccaucugcaacuucaagggcaccaugcaggccaagcucaacgaggagccccgcuaccagcuccagcucaccaaccucgacggcucccccaucgaccccaccgacgacaugcccgccccccucggcacccccgacuuccaggccaugcucuacggcgucgccucccagcgcuccucccgcgacaacgccacccgcgcccacgacgcccagaucgacaccgccggcgacaccuucgcccccaagaucggccagguccgcuucaaguccuccuccaacgacuucgaccuccacgaccccaccaaguucacccccaucggcgucaacgucgacgaccagcaccccuuccgccagugguuccuccccaacuacggcggccaccucgcccucaacaaccaccucgcccccgccgucaccccccucuuccccggcgagcagauccucuucuuccgcuccuacauccccuccgccggcggccacaccgacggcgccauggacugccuccucccccaggagugggucgagcacuucuaccaggaggccgcccccucccaguccgacaucgcccucguccgcuucaucaaccccgacaccggccgcguccucuucgaggccaagcuccacaagcagggcuuccucaccaucgccgccuccggcgaccaccccaucgucaugcccaccaacggcuacuuccgcuucgaggccugggucaaccccuucuacacccucgcccccgucggcaccggcuccggccgccgccgcauccaguga

SEQ ID NO: 14807 - RNA, 1626 nt, Artificial Sequence
  derived and/or modified sequence opt2 from capsid_protein__Norovirus__ABS29273
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccaucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccaguccggcaucggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgccgaccaggcccccuaccagggccgcgucuucgccuccgucaccgccgccgccucccucgaccucgucgacggccgcguccgcgccgucccccgcuccgucuacuccuucugcgacaccauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 14808 - RNA, 1626 nt, Artificial Sequence
  derived and/or modified sequence opt2 from capsid_protein__Norovirus__ABS29275
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccaguccggcaucggcgaggucgccaccuucacccucaucgagcaggacggcuccgccuacauccccggcgaccgcgccgccccccucggcuaccccgacuucuccggccagcucgagaucgagguccagaccgagaccaccaagaccggcgacaagcucaaggucaccaccuucgagaugguccucggccccaccaccaacgucgaccaggcccccuaccagggccgcgucuacgccuccgucaccgccgccgccucccucgaccucgucgacggccgcguccgcgccgucccccgcuccaucuacuccuuccaggacaccauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 14809 - RNA, 1626 nt, Artificial Sequence
  derived and/or modified sequence opt2 from capsid_protein__Norovirus__ABU55541
augcgcauguccgacggcgccgcccccaaggccaacggcuccgaggccuccggccaggaccucguccccgccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacaaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgccgaccaggcccccuaccagggccgcgucuucgccuccgucaccgccgccgccucccucgaccucgucgacggccgcguccgcgccgucccccgcuccaucuacggcuuccaggacaccauccccgaguacaacgacggccuccucgucccccucgccccccccaucggccccuuccuccccggcgagguccuccuccgcuuccgcaccuacaugcgccagaucgacaccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacaacgagggcuacaucgcccucuccuacuccggcuccggcccccucaccuuccccaccgacggcaucuucgaggucgucuccugggucccccgccucuaccagcucgccuccgucggcucccucgccaccggccgcaugcucaagcaguga

SEQ ID NO: 14810 - RNA, 1626 nt, Artificial Sequence; identical to SEQ ID NO: 14809
  derived and/or modified sequence opt2 from capsid_protein__Norovirus__ABU55544

SEQ ID NO: 14811 - RNA, 1626 nt, Artificial Sequence
  derived and/or modified sequence opt2 from capsid_protein__Norovirus__ABU55547
augcgcauguccgacggcgccgcccccaaggccaacggcuccgaggccuccggccaggaccucguccccgccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacaaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgccgaccaggcccccuaccagggccgcgucuucgccuccgucaccgccgccgccucccucgaccucgucgacucccgcguccgcgccgucccccgcuccaucuacggcuuccaggacaccauccccgaguacaacgacggccuccucgucccccucgccccccccaucggccccuuccuccccggcgagguccuccuccgcuuccgcaccuacaugcgccagaucgacaccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacaacgagggcuacaucgcccucuccuacuccggcuccggcccccucaccuuccccaccgacggcaucuucgaggucgucuccugggucccccgccucuaccagcucgccuccgucggcucccucgccaccggccgcaugcucaagcaguga

SEQ ID NO: 14812 - RNA, 1626 nt, Artificial Sequence; identical to SEQ ID NO: 14809
  derived and/or modified sequence opt2 from capsid_protein__Norovirus__ABU55550

SEQ ID NO: 14813 - RNA, 1626 nt, Artificial Sequence; identical to SEQ ID NO: 14809
  derived and/or modified sequence opt2 from capsid_protein__Norovirus__ABU55553

SEQ ID NO: 14814 - RNA, 1626 nt, Artificial Sequence
  derived and/or modified sequence opt2 from capsid_protein__Norovirus__ABU55556
augcgcauguccgacggcgccgcccccaaggccaacggcuccgacgccuccggccaggaccucguccccgccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacaaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgccgaccaggcccccuaccagggccgcgucuucgccuccgucaccgccgccgccucccucgaccucgucgacggccgcguccgcgccgucccccgcuccaucuacggcuuccaggacaccauccccgaguacaacgacggccuccucgucccccucgccccccccaucggccccuuccuccccggcgagguccuccuccgcuuccgcaccuacaugcgccagaucgacaccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacaacgagggcuacaucgcccucuccuacuccggcuccggcccccucaccuuccccaccgacggcaucuucgaggucgucuccugggucccccgccucuaccagcucgccuccgucggcucccucgccaccggccgcaugcucaagcaguga

SEQ ID NO: 14815 - RNA, 1626 nt, Artificial Sequence
  derived and/or modified sequence opt2 from capsid_protein__Norovirus__ABU55559
augcgcauguccgacggcgccgcccccaaggccaacggcuccgaggccuccggccaggaccucguccccgccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgccgaccaggcccccuaccagggccgcgucuucgccuccgucaccgccgccgccucccucgaccucgucgacggccgcguccgcgccgucccccgcuccaucuacggcuuccaggacaccauccccgaguacaacgacggccuccucgucccccucgccccccccaucggccccuuccuccccggcgagguccuccuccgcuuccgcaccuacaugcgccagaucgacaccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacaacgagggcuacaucgcccucuccuacuccggcuccggcccccucaccuuccccaccgacggcaucuucgaggucgucuccugggucccccgccucuaccagcucgccuccgucggcucccucgccaccggccgcaugcucaagcaguga

SEQ ID NO: 14816 - RNA, 1626 nt, Artificial Sequence; identical to SEQ ID NO: 14809
  derived and/or modified sequence opt2 from capsid_protein__Norovirus__ABU55562

SEQ ID NO: 14817 - RNA, 1626 nt, Artificial Sequence; identical to SEQ ID NO: 14809
  derived and/or modified sequence opt2 from capsid_protein__Norovirus__ABU55565

SEQ ID NO: 14818 - RNA, 1626 nt, Artificial Sequence
  derived and/or modified sequence opt2 from capsid_protein__Norovirus__ABU55568
augcgcauguccgacggcgccgcccccaaggccaacggcuccgaggccuccggccaggacuucguccccgccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccgucuaccgcauggucgaccuccccguccuccagccccgccucugcacccacgcccgcuggcccgcccccgucuacggccuccucaucgaccccucccuccccuccaacccccaguggcagaacggccgcguccacgucaacggcacccuccucggcaccacccccgucuccggcuccugggucuccugcuucgccgccgaggccgccuacgaguuccaguccggcaucggcgaggucgccaccuucaccaugaucgagcaggacggcuccgccuacguccccggcgaccgcgccgccccccucggcuaccccgacuucuccggccagcucgagaucgagguccagaccgagaccaccaaguccggcgacaagcucaaggucaccaccuucgagaugauccucggccccaccaccaacgccgaccagacccccuaccagggcaaggucuacgccuccaucgccgccgccgccucccucgaccucgucgacggccgcguccgcgccgucccccgcuccgucuacgccuuccaggacguccuccccgaguacaacgacggccuccucgucccccucgcccccccccucggccccuuccuccccggcgagguccuccuccgcuuccgcaccuacguccgccagcucgacaccgccgacgccgccgcccagcccaucgacugcgcccucccccaggaguucaucuccugguucgccuccaacaacuucaccguccaguccgacgcccuccucauccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14819 - RNA, 1626 nt, Artificial Sequence
  derived and/or modified sequence opt2 from capsid_protein__Norovirus__ABU55571
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccgucuaccgcauggucgaccuccccguccuccagccccgccucugcacccacgcccgcuggcccgcccccaucuacggccuccucaucgaccccucccuccccuccaacccccaguggcagaacggccgcguccacgucaacggcacccuccucggcaccacccccgucuccggcuccugggucuccugcuucgccgccgaggccgccuacgaguuccaguccggcaccggcgaggucgccaccuucaccaugaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugguccucggccccaccaccaacgucgaccaggcccccuaccagggccgcaccuacgccucccucaccgccgccgccucccucgaccucgucgacggccgcguccgcgccgucccccgcuccaucuacuccuuccaggacguccuccccgaguacaacgacggccuccucgucccccucgcccccccccucggccccuuccuccccggcgagguccuccuccgcuuccgcaccuacaugcgccagcucgacaccgccgacgccgccgcccagcccaucgacugcgcccucccccaggaguucaucuccugguucgccuccaacaacuucaccguccaguccgacgcccuccucauccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14820 - RNA, 1626 nt, Artificial Sequence
  derived and/or modified sequence opt2 from capsid_protein__Norovirus__ABU55577
augcgcauguccgacggcgccgcccccaaggccaacggcuccgaggccaucggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcgcccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccgucuaccgcauggucgaccuccccguccuccagccccgccucugcacccacgcccgcuggcccgcccccgucuacggccuccucgucgaccccucccuccccuccaacccccaguggcagaacggccgcguccacgucaacggcacccuccucggcaccacccccgucuccggcuccugggucuccugcuucgccgccgaggccgccuacgaguuccaguccggcaccggcgaggucgccaccuucaccaugaucgagcaggacggcuccgccuacguccccggcgaccgcgccgccccccucggcuaccccgacuucuccggccagcucgagaucgagguccagaccgagaccaccaaguccggcgacaagcucaaggucaccaccuucgagaugauccucggccccaccaccaacgccgaccagacccccuaccagggccgcgucuacgccuccaucgccgccgccgccccccucgaccucgucgacggccgcguccgcgccgucccccgcuccgucuacuucuuccaggacguccuccccgaguacaacgacggccuccucgucccccucgcccccccccucggccccuuccuccccggcgagguccuccuccgcuuccgcaccuacguccgccagcucgacaccgccgacgccgccgcccagcccaucgacugcgcccucccccaggaguucaucuccugguucgccuccaacuccuucaccguccaguccgaggcccuccucauccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14821 - RNA, 1626 nt, Artificial Sequence
  derived and/or modified sequence opt2 from capsid_protein__Norovirus__ABU55580
augcgcauguccgacggcgccgcccccaaggccaacggcuccgaggccaucggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcgcccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccgucuaccgcauggucgaccuccccguccuccagccccgccucugcacccacgcccgcuggcccgcccccgucuacggccuccucgucgaccccucccuccccuccaacccccaguggcagaacggccgcguccacgucaacggcacccuccucggcaccacccccgucuccggcuccugggucuccugcuucgccgccgaggccgccuacgaguuccaguccggcaccggcgaggucgccaccuucaccaugaucgagcaggacggcuccgccuacguccccggcgaccgcgccgccccccucggcuaccccgacuucuccggccagcucgagaucgagguccagaccgagaccaccaaguccggcgacaagcucaaggucaccaccuucgagaugauccucggccccaccaccaacgccgaccaggcccccuaccagggccgcgucuacgccucccucgccgccgccgccccccucgaccucgucgacggccgcguccgcgccgucccccgcuccgucuacuucuuccaggacguccuccccgaguacaacgacggccuccucgucccccucgcccccccccucggccccuuccuccccggcgagguccuccuccgcuuccgcaccuacguccgccagcucgacaccgccgacgccgccgcccagcccaucgacugcgcccucccccaggaguucaucuccugguucgccuccaacuccuucaccguccaguccgaggcccuccucauccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14822 - RNA, 1626 nt, Artificial Sequence
  derived and/or modified sequence opt2 from capsid_protein__Norovirus__ABU55586
augcgcauguccgacggcgccgcccccaaggccaacggcuccgaggccaucggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcgcccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccgucuaccgcauggucgaccuccccguccuccagccccgccucugcacccacgcccgcuggcccgcccccgucuacggccuccucgucgaccccucccuccccuccaacccccaguggcagaacggccgcguccacgucaacggcacccuccucggcaccacccccgucuccggcuccugggucuccugcuucgccgccgaggccgccuacgaguuccaguccggcaccggcgaggucgccaccuucaccaugaucgagcaggacggcuccgccuacguccccggcgaccgcgccgccccccucggcuaccccgacuucuccggccagcucgagaucgagguccagaccgagaccaccaaguccggcgacaagcucaaggucaccaccuucgagaugauccucggccccaccaccaacgccgaccaggcccccuaccagggcaaggucuacgccucccucgccgccgccgccccccucgaccucgucgacggccgcguccgcgccgucccccgcuccgucuacuucuuccaggacguccuccccgaguacaacgacggccuccucgucccccucgcccccccccucggccccuuccuccccggcgagguccuccuccgcuuccgcaccuacguccgccagcucgacaccgccgacgccgccgcccagcccaucgacugcgcccucccccaggaguucaucuccugguucgccuccaacuccuucaccguccaguccgacgcccuccucauccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14823 - RNA, 1626 nt, Artificial Sequence
  derived and/or modified sequence opt2 from capsid_protein__Norovirus__ABU55589
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccgucuaccgcauggucgaccuccccguccuccagccccgccucugcacccacgcccgcuggcccgcccccgucuacggccuccucaucgaccccucccuccccuccaacccccaguggcagaacggccgcguccacgucaacggcacccuccucggcaccacccccgucuccggcuccugggucuccugcuucgccgccgaggccgccuacgaguuccaguccggcaccggcgaggucgccaccuucaccaugaucgagcaggacggcuccgccuacguccccggcgaccgcgccgccccccucggcuaccccgacuucuccggccagcucgagaucgagguccagaccgagaccaccaaguccggcgacaagcuccgcgucaccaccuucgagaugauccucggccccaccaccaacgucgaccaggcccccuaccagggccgcgucuacgccucccucgccgccgccgccucccucgaccucgucgacggccgcguccgcgccgucccccgcuccgucuacuccuuccaggacguccuccccgaguacaacgacggccuccucgucccccucgcccccccccucggccccuuccuccccggcgagguccuccuccgcuuccgcaccuacaugcgccagcucgacaccgccgacgccgccgcccagcccaucgacugcgcccucccccaggaguucaucuccugguucgccuccaacaacuucaccguccaguccgacgcccuccucauccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14824 - RNA, 1626 nt, Artificial Sequence
  derived and/or modified sequence opt2 from capsid_protein__Norovirus__ABU55598
augcgcauguccgacggcgccgcccccaaggccuccggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacaucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccacccgcgccggcgacaagcucaaggucaccaccuucgagaugauccucggccccaccaccaacgucgaccaggcccccuaccagggccgcgucuacgccucccucaccgccgccgccucccucgaccucgucgacggccgcguccgcgccgucccccgcuccaucuacuccuuccaggacguccuccccgaguacaacgacggccuccucgucccccucgccccccccaucggccccuuccuccccggcgagguccuccuccgcuuccgcaccuacaugcgccaggucgacuccuccgacgccgccgccgaggccaucgacugcgcccucccccaggaguucgucuccugguucgccuccaacggcuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuuccagcucgccuccgucggcucccucgucaccggccgcacccucaagcaguga

SEQ ID NO: 14825 - RNA, 1626 nt, Artificial Sequence
  derived and/or modified sequence opt2 from capsid_protein__Norovirus__ABU55601
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggccgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccaguccggcaccggcgaggucgccacccucacccucaucgagcaggacggcuccgccuacguccccggcgaccgcgccgccccccucggcuaccccgacuucuccggccagcucgagaucgagguccagaccgagaccaccaaggccggcgacaagcucaaggucaccaccuucgacaugauccucggccccaccaccaacgucgaccaggcccccuaccagggccgcgucuacgccuccgucuccaccgccgccucccucggccucgucgacggccgcguccgcgccgucccccgcuccaucuacggcuuccaggacaccauccccgaguacaacgacggccuccucgucccccucgccccccccaucggccccuuccuccccggcgagguccuccuccgcuuccgcaccuacaugcgccagaucgacaccgccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggccgucuccugggucccccgccucuaccagcucgccuccgucggcucccucgccaccggccgcacccucaagcaguga

SEQ ID NO: 14826 - RNA, 1626 nt, Artificial Sequence
  derived and/or modified sequence opt2 from capsid_protein__Norovirus__ABU55604
augcgcauguccgacggcgccgccccccgcgccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccaucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggccgcgucuacgccuccgucgccgccgccgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccgccgacggcuucuucgaggucgucuccugggucccccgccucuaccagcucgccuccgucggcucccucgccaccggccgcaugcuccgccaguga

SEQ ID NO: 14827 - RNA, 1626 nt, Artificial Sequence
  derived and/or modified sequence opt2 from capsid_protein__Norovirus__ABU55607
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgcccccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccaggucgacggcacccuccucggcaccacccccgucuccggcuccugggucuccugcuucgccgccgaggccgccuacgaguuccaggccggcaccggcgaggucgucaccuucaccaugaucgagcaggacggcuccgccuacguccccggcgaccgcgccgccccccucggcuaccccgacuucuccggccagcucgagaucgagguccagaccgagaccaccaagaccggcgacaagcuccgcgucaccaccuucgagaugauccucggccccaccaccaacgucgaccaggcccccuaccagggccgcgccuacgccucccucaccgccgccgccucccucgaccucgucgacggccgcguccgcgccgucccccgcuccaucuacuccuuccaggacgagcuccccgaguacaacgacggccuccucgucccccucgcccccccccucggccccuuccuccccggcgagguccuccuccgcuuccgcaccuacaugcgccagcucgacaccgccgacgccgccgcccagcccaucgacugcgcccucccccaggaguucaucuccugguucgccuccaacaacuucaccguccaguccgacgcccuccucguccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgucaccggccgcacccucaagcaguga

SEQ ID NO: 14828 - RNA, 1626 nt, Artificial Sequence
  derived and/or modified sequence opt2 from capsid_protein__Norovirus__ABU55610
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccgucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccuccgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccaguccggcaccggcgaggucgccaccuucacccucgucgagcaggacggcuccgccuacguccccggcgaccgcgccgccccccucggcuaccccgacuucuccggccagcucgagaucgagguccagaccgagaccaccaagcccggcgagaagcucaaggucaccaccuucgagaugauccucggccccaccaccaacgucgaccaggcccccuaccgcggcaaggucuucgccuccaucaccaccgccgccucccucucccucgucgacggccgcguccgcgccgucccccgcuccaucuacuccuuccaggacgucauccccgaguacaacgacggccuccucgucccccucgccccccccaucggccccuuccuccccggcgagguccuccuccgcuuccgcaccuacaugcgccagcucgacuccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 14829 - RNA, 1626 nt, Artificial Sequence
  derived and/or modified sequence opt2 from capsid_protein__Norovirus__ABU55613
augcgcauguccgacggcgccgcccccaaggccaacggcuccgaggccuccggccaggaccucguccccaccgccgucgagcaggccguccccauccagcccgucgccggcuccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggccgcgucuacgccucccucaccgccgucgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucaucuccugguucgccuccaacgccuucaccguccaguccgacgcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuuccagcucgccuccgucggcucccucaccaccggccgcacccucaagcaguga

SEQ ID NO: 14830 - RNA, 1626 nt, Artificial Sequence
  derived and/or modified sequence opt2 from capsid_protein__Norovirus__ABU55616
augcgcauguccgacggcgccgcccccaaggccaacggcuccgaggccuccggccaggaccucguccccaccgccaucgagcaggccguccccauccagcccgucgccggcuccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggcaaggucuacgccucccucgccgucgccgccucccucgaccucgucgacggccgcguccgcgccgucccccgcuccaucuacggcuuccaggacgucauccccgaguacaacgacggccuccucgucccccucgccccccccaucggccccuuccuccccggcgagauccuccuccgcuuccgcaccuacaugcgccagcucgacaccgccgacgccgccgccgaggccaucgacugcgcccucccccaggaguucaucuccugguucgccuccaacgccuucaccguccaggccgacgcccuccuccuccgcuaccgcaacacccucaccggccagcuccucuucgagugcaagcucuacuccgagggcuacaucgcccucuccuacuccggcuccgccccccucaccuuccccaccgacggcuucuucgaggucgucuccugggucccccgccucuuccagcucgccuccgucggcucccucaccaccggccgcacccucaagcaguga

SEQ ID NO: 14831 - RNA, 1626 nt, Artificial Sequence
  derived and/or modified sequence opt2 from capsid_protein__Norovirus__ABU55619
augcgcauguccgacggcgccgcccccaaggccaacggcuccgaggccuccggccaggaccucguccccaccgccgucgagcaggccguccccauccagcccgucgccggcuccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggccaggucgccaccuucacccucaucgagcaggacggcuccgccuacguccccggcgaccgcgccgccccccucggcuaccccgacuucuccggccagcucgagaucgagguccagaccgagaccaccaaggccggcgacaagcucaaggucaccaccuucgagaugauccucggccccaccaccaacgucgaccaggcccccuaccagggccgcgucuacgccucccucgccgucgccgccucccucgaccucgucgacggccgcguccgcgccgucccccgcuccauccacggcuuccaggacgucauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucaucuccugguucgccuccaacgccuucaccguccaguccgacgcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14832 - RNA, 1626 nt, Artificial Sequence
  derived and/or modified sequence opt2 from capsid_protein__Norovirus__ABU55622
augcgcauguccgacggcgccacccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccacgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggccgcgucuucgccuccgucaccgccgccgccucccucgaccucgucgacggccgcguccgcgccgucccccgcuccaucuacggcuuccaggacaccauccccgaguacaacgacggccuccucgucccccucgccccccccaucggccccuuccuccccggcgagguccuccuccgcuuccgcaccuacaugcgccagcucgacaccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcucccucaccuuccccaccgacggcuucuucgaggucgucuccugggucccccgccucuaccagcucgccuccgucggcucccucgccaccggccgcacccucaagcaguga

SEQ ID NO: 14833 - RNA, 1623 nt, Artificial Sequence
  derived and/or modified sequence opt2 from capsid_protein__Norovirus__ABU55628
augcgcauguccgacggcgccguccccaaggccaacggcuccgaggccuccggccaggaccucguccccaccgccgucgagcaggccguccccauccagcccgucgccggcgccuccaucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgagaagcucaaggucaccaccuucgagaugauccucggccccgccaccaacgucgaccaggcccccuuccagggccgcgucuacgccucccucaccgccgucgccucccucgaccucgucgacggccgcguccgcgccgucccccgcuccaucuacgccuuccaggacgucauccccgaguacaacgacggccuccucgucccccucgccccccccaucggccccuuccuccccggcgagcuccuccuccgcuuccgcaccuacaugcgccagaucgacuccuccgacgccgccgccgaggccaucgacugcgcccucccccaggaguucaucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccgccgacggcuucuucgaggucgucuccugggucccccgccucuuccagcucgccuccgucggcuccuccgccaccggccgcacccucaaguga

SEQ ID NO: 14834 - RNA, 1593 nt, Artificial Sequence
  derived and/or modified sequence opt2 from capsid_protein__Norovirus__ABW74121
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcuccggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccggcaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucaacuccggcaacuacaucggcguccucuccugggucuccccccccucccaccccuccggcucccaggucgaccucuggaagauccccaacuacggcuccuccaucaccgaggccacccaccucgcccccuccgucuucccccccggcuucggcgagguccucgucuucuucauguccaagauccccggccccggcgccuacucccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccaccgcccgcggccgccucggccuccgccgcuga

SEQ ID NO: 14835 - RNA, 1593 nt, Artificial Sequence
  derived and/or modified sequence opt2 from capsid_protein__Norovirus__ABW74123
augaugauggccuccaaggacgccaccuccuccgucgacggcgccuccggcgccggccagcucguccccgaggucaacgccuccgacccccucgccauggaccccgucgccggcuccuccaccgccgucgccaccgccggccaggucaaccccaucgaccccuggaucaucaacaacuucguccaggccccccagggcgaguucaccaucucccccaacaacacccccggcgacguccucuucgaccucucccucggcccccaccucaaccccuuccuccuccaccucucccagauguacaacggcugggucggcaacaugcgcguccgcaucaugcucgccggcaacgccuucaccgccggcaagaucaucgucuccugcaucccccccggcuucggcucccacaaccucaccaucgcccaggccacccucuucccccacgucaucgccgacguccgcacccucgaccccaucgaggucccccucgaggacguccgcaacguccucuuccacaacaacgaccgcaaccagcagaccaugcgccucgucugcaugcucuacaccccccuccgcaccggcggcggcaccggcgacuccuucgucgucgccggccgcgucaugaccugccccucccccgacuucaacuuccucuuccucgucccccccaccgucgagcagaagacccgccccuucacccuccccaaccucccccucuccucccucuccaacucccgcgccccccuccccaucuccggcaugggcaucucccccgacaacguccaguccguccaguuccagaacggccgcugcacccucgacggccgccucgucggcaccacccccgucucccucucccacgucgccaagauccgcggcaccuccaacggcaccgucaucaaccucaccgagcucgacggcacccccuuccaccccuucgagggccccgcccccaucggcuuccccgaccucggcggcugcgacuggcacaucaacaugacccaguucggccacuccucccagacccaguacgacgucgacaccacccccgacaccuucgucccccaccucggcuccauccaggccaacggcaucaacuccggcaacuacaucggcguccucuccugggucuccccccccucccaccccuccggcucccaggucgaccucuggaagauccccaacuacggcuccuccaucaccgaggccacccaccucgcccccuccgucuucccccccggcuucggcgagguccucgucuucuucauguccaagauccccggccccggcgccuacucccuccccugccuccucccccaggaguacaucucccaccucgccuccgagcaggcccccaccgucggcgaggccgcccuccuccacuacgucgaccccgacaccggccgcaaccucggcgaguucaaggccuaccccgacggcuuccucaccugcguccccaacggcgccuccuccggcccccagcagcuccccaucaacggcgucuucgucuucgucuccugggucucccgcuucuaccagcucaagcccgucggcaccgccuccaccgcccgcggccgccucggccuccgccgcuga

SEQ ID NO: 14836 - RNA, 1593 nt, Artificial Sequence; identical to SEQ ID NO: 14835
  derived and/or modified sequence opt2 from capsid_protein__Norovirus__ABW74124

SEQ ID NO: 14837 - RNA, 1593 nt, Artificial Sequence; identical to SEQ ID NO: 14835
  derived and/or modified sequence opt2 from capsid_protein__Norovirus__ABW74125

SEQ ID NO: 14838 - RNA, 1593 nt, Artificial Sequence; identical to SEQ ID NO: 14835
  derived and/or modified sequence opt2 from capsid_protein__Norovirus__ABW74126

SEQ ID NO: 14839 - RNA, 1593 nt, Artificial Sequence; identical to SEQ ID NO: 14835
  derived and/or modified sequence opt2 from capsid_protein__Norovirus__ABW74127

SEQ ID NO: 14840 - RNA, 1593 nt, Artificial Sequence; identical to SEQ ID NO: 14835
  derived and/or modified sequence opt2 from capsid_protein__Norovirus__ABW74128

SEQ ID NO: 14841 - RNA, 1620 nt, Artificial Sequence
  derived and/or modified sequence opt2 from capsid_protein__Norovirus__ABW74532
augaagauggccuccuccgacgccaaccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacgucaucgucgacguccgccagcucgagcccguccucaucccccuccccgacguccgcaacaacuucuaccacuacaaccaggcccacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgacuucgucguccagccccagaacggccgcugcaccaccgacggcguccuccucggcaccacccagcucuccgccgucaacaucugcaacuucaagggcgacgucacccacaucgccggcucccgcgacuaccgcaugaaccucgucucccagaacuggaacaacuacgaccccaccgaggagauccccgccccccucggcacccccgacuuccagggcaagauccagggccuccucacccagaccaccggcgccgacggcuccacccgcgcccacaaggccaccgucuccaccggcgccgccaacuucacccccaagcucggcuccguccaguucaccaccgacaccgacaacgacuuccagaccggccagaacaccaaguucacccccgucggcgucauccaggacggcucccaccaccagaacgagccccagcaguggguccuccccaacuacuccggccgcaccguccacaacguccaccucgcccccgccgucgcccccaccuuccccggcgagcagcuccucuucuuccgcuccaccaugcccggcugcuccggcuaccccaacaugaaccucgacugccuccucccccaggagugggucaugcacuucuaccaggaggccgcccccgcccaguccgacgucgcccuccuccgcuucgucaaccccgacaccggccgcguccucuucgagugcaagcuccacaaggccggcuacaucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14842 - RNA, 1620 nt, Artificial Sequence
  derived and/or modified sequence opt2 from capsid_protein__Norovirus__ABW74533
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcggcgacggcuccacccgcgcccacaaggccaccgucuccaccggcuccguccacuucacccccaagcucggcuccguccaguucaccaccgacaccaacaacgacuuccagaccggccagaacaccaaguucacccccgucggcgucauccaggacggcgacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14843 - RNA, 1623 nt, Artificial Sequence
  derived and/or modified sequence opt2 from capsid_protein__Norovirus__ABW74534
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcacccgccccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucucccagaccacccgcggcgacggcuccacccgcggccacaaggccaccgucuccaccggcuccguccacuucacccccaagcucggcuccguccaguucaccaccgacaccaacaacgaccucgagaccggccagaacaccaaguucacccccgucggcgucguccaggacggcaacuccacccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14844 - RNA, 1623 nt, Artificial Sequence; identical to SEQ ID NO: 14734
  derived and/or modified sequence opt2 from capsid_protein__Norovirus__ABW74535

SEQ ID NO: 14845 - RNA, 1620 nt, Artificial Sequence
  derived and/or modified sequence opt2 from capsid_protein__Norovirus__ABW74536
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagaccauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccaggccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcaccggccgccgccgcgcccucuga

SEQ ID NO: 14846 - RNA, 1623 nt, Artificial Sequence
  derived and/or modified sequence opt2 from capsid_protein__Norovirus__ABW74537
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccgcccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaagaccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14847 - RNA, 1623 nt, Artificial Sequence
  derived and/or modified sequence opt2 from capsid_protein__Norovirus__ABW74538
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcuccaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucaccaccgacaccaacaacgaccucgagaccggccagaacacccgcuucacccccgucggcgucguccaggacggcaacuccacccaccagaacgagccccagcaguggguccuccccaacuacuccggccgcgccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14848 - RNA, 1623 nt, Artificial Sequence
  derived and/or modified sequence opt2 from capsid_protein__Norovirus__ABW74539
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccgcaacuacaccaugaaccucgccucccagaacuggaacaacuacgaccccaccgaggagauccccgccccccucggcacccccgacuucgucggccgcauccagggcaugcucacccagaccacccgccgcgacggcuccacccgcggccacaaggccaccgucuccaccggcgacgcccacuucacccccaagcucggcuccaucauguucuccaccgacaccgacaacgacuucgagaccggccagaacaccaaguucacccccgucggcgucguccaggacggcaacggcacccaccagaacgagccccagcaguggguccuccccuccuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14849 - RNA, 1623 nt, Artificial Sequence; identical to SEQ ID NO: 13717
  derived and/or modified sequence opt2 from capsid_protein__Norovirus__ABW74540

SEQ ID NO: 14850 - RNA, 1623 nt, Artificial Sequence
  derived and/or modified sequence opt2 from capsid_protein__Norovirus__ABW74541
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccuccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcaacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14851 - RNA, 1623 nt, Artificial Sequence
  derived and/or modified sequence opt2 from capsid_protein__Norovirus__ABW74542
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14852 - RNA, 1623 nt, Artificial Sequence; identical to SEQ ID NO: 13702
  derived and/or modified sequence opt2 from capsid_protein__Norovirus__ABW74544

SEQ ID NO: 14853 - RNA, 1623 nt, Artificial Sequence; identical to SEQ ID NO: 14265
  derived and/or modified sequence opt2 from capsid_protein__Norovirus__ABW74545

SEQ ID NO: 14854 - RNA, 1623 nt, Artificial Sequence
  derived and/or modified sequence opt2 from capsid_protein__Norovirus__ABW74546
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuuccaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14855 - RNA, 1566 nt, Artificial Sequence
  derived and/or modified sequence opt2 from capsid_protein__Norovirus__ABW75843
augaagauguccgacaaggaguccgccgagucccccgccucccucggccagguccuccccccccaggucgacgucgucguccccgucgagcccaccgucggcgcccagaucgccgcccccaccgccggccagaucaaccccaucgaccccuggaucuucuccaacuucguccaggccccccagggcgaguucaccaucucccccaacaacaaccccggcgagauccucuucgagauggagcucggccccgaccucaaccccuaccucggccaccuccgccgcauguacaacggcuggaccggcucccuccgcguccgcgucaugcucgccggcaacgccuucuccgccggcaagaucaucgucuucugcaucccccccggcuucgacaccaccuuccucacccccgcccaggccacccaguucccccacgucaucauggacguccgcgcccccgaccccgucgaggucccccucgaggacguccgcaacguccucuuccaccagggccccgacaaccgcaugcgccucgucggcaugcucuacaccccccuccgcgccaacuccggcgccgaccccuucgucgucaccggccgcguccucaccugccccuccgagaacuucuccuucuucuuccucgucccccccaccgucgaggagaaggacguccccuucaccauccccaacguccccaccuccucccucaccaacucccgcaugcucgagcccgucgccgagcuccgcuccucccgcaacuucgcccucuccguccaguuccagaacggccgcuccaccaucgagggcgagcuccucggcaccacccccgccucccucgccgaccucggcuccuuccucugcauccgcggcggcaccgccaaccucgccgagcucuuccagcccaacgaggacgccuucgucgccggcucccaccccgcccccuucggcuuccccgacuucuccaacugcacccucgacuuccuccucuacgacgccaacggccucuaccaccgccaccucgacgucaccuccgccuccaacuucacccccgcccucggccacaucacccucgacggcuccguccccgaccgccucacccgcgcccgccucgagggcguccagcgcgccuccgagaacaccuucuggcgcaugcccgacuaccgcggcgacguccucggcgccgaguucgcccccgccgucuccgcccccggcaucggcgagacccuccucuucuucauguccaacguccccuaccacaacggcuccaaccccaacccccuccccugccuccucccccucgaguggaucaaccacuucgucgccgagcgccccgccaagcaguccgacgucgcccuccucaacuacaucaacccccucaccggccgcguccucuucgagugcaagcucuacuccgccggcuuccucgccgucaaccucggcucccagaccgaggucacccuccccgucgacggcaucuucaaguucgucuccugggucuccuacuacuaccagcuccgccccgucggcaccgucuccgucggccgccgccucccccgccucgacggccacuga

SEQ ID NO: 14856 - RNA, 1737 nt, Artificial Sequence
  derived and/or modified sequence opt2 from capsid_protein__Norovirus__ABX71062
augaagauggccuccaacgacgccgcccccuccuccgacggcgccggcaaccucguccccgagucccaccaggagguccucccccucgcccccgucgccggcgccgccaucgccgcccccgucgucggccagcagaacaucaucgaccccuggaucaaggagaacuucguccaggccccccagggcgaguucaccgucucccccaagaacucccccggcgagguccucgucaaccucgagcucucccccaagcucaaccccuaccucgaccaccucuccaagauguacaacgccuacgccggcggcauggagaucgagaucauccucgccggcaacgccuucaccgccggcaagguccucaucgccgccgucccccccaacuuccccgucgagaacaucuccgucucccaggccucccaguucccccacgucaucgucgacguccgcacccucgagcccauccgccucccccuccccgacguccgcaccaacuucuuccacuacaccacccgcgacgagcccaagaugcgcaucgucgccuggcucuacaccccccuccgcaccaacggcuccggcgacgacuccuucaccgucuccggccgcauccucacccgccccuccgccgacuucgaguucuccuuccucgucccccccaccgucgagaccaagaccgucuccuucuccguccccggccucaccgucgaggagauguccaacucccgcuggcccgcccagaucaacggccucgucguccgcggcaacgaggcccaggucguccacuuccagaacggccgcugcaccaccgagggcaugcuccucggcaccaccacccucaacgucaacuccaucugcggccuccgcggcaccuccaucucccacgccuccguccgcgaggcccccgcccucuccgaggagaugcccccccucgaggacgaggucgcccacggcgccgccgccaccuacgccgucggccgcgccgccgacaccacccucuggauccgcgucgaggagcccaacggccagcccuacgacaucuucggcgagcagcccgccccccucggcacccccgacuucaccgccgucaucaucggcaccgccauccgcccccgcaccgccuccggcgccuaccuccacgacgccuacgucgacacccgccccggcgacgccgacuucacccccuccaccggcaacaccaagaucguccuccgcggcggcggcuccggccacgucggcgagggccacuacuggcaguucaagcccaucgccgucgagggcggccccaaccgccccgucuaccaggaguacaaccuccccgaguacgccggccccaccgccuccaaccacaaccucgccccccccgucgcccccaagaugcccggcgagcuccuccuccucuucgaguccgacaugcccgucugggacaacggcuccggcuccgcccccacccagaagauccacugccuccuccccaacgacuucgucacccacuucuucgaccuccaggcccccgcccucgccgaggccgcccuccuccgcuacguccaccccgacuccggccgcacccucuucgagugcaagcucuaccgcgagggcuacauggucgucgucgcccccuccggccgccucgacuucccccucgacggcuacuuccgcuucgacuccugggucaacgccuucuacguccucucccccgucggcaacggccagggccgccgcggccgcgccaagaacaucuga

SEQ ID NO: 14857 - RNA, 1605 nt, Artificial Sequence
  derived and/or modified sequence opt2 from capsid_protein__Norovirus__ABY77754
augaagauggccuccaacgacgccucccccuccuccgacggcuccgccaaccucguccccgagaucaacaacgaggucauggcccucgagcccgucgccggcgccgccaucgccgcccccgucgccggccagcagaacaucaucgaccccuggauccgcaacaacuucguccaggcccccggcggcgaguucaccgucuccccccgcaacgcccccggcgagguccuccucaaccucccccucucccccgacaucaaccccuaccucgcccaccucucccgcauguacaacggcuacgccggcggcgucgaggucgaggucguccucgccggcaacgccuucaccgccggcaagaucaucuucgccgccgucccccccaacuucccccccgagaaccucucccccucccagaucaccaugcucccccacaucaucgucgacguccgccagcucgagcccguccgcaucccccuccccgacguccgcaacaacuucuaccacuacucccgcgagaacgacuccacccuccgccucgucgccaugcucuacaccccccuccgcgccaacaacgccggcgacgacgucuucaccgucuccugccgcguccucacccgccccucccccgacuucgacuucaucuuccucgucccccccaccgucgaguccaaguccaagcccuucaccauccccauccucaccaucgaggagaugaccaacucccgcuuccccgccccccucgagaugaugaccaccggccccucccacgacaucgucguccagccccagaacggccgcugcaccaucgacggcguccuccucggcaccacccagcucucccccgucaacaucugcuccaugcgcggcguccccaccaagcgcaccaacggcaccgacaacugcuucguccagcucgagaaccccaacggcuccgccuacgaccccaccgaggacauccccgccguccucggcucccccgacuucgucggcgaguucuacggcaccaucacccagcgcucccccaacaacuccacccgcgcccaccccuucacccucaacaccggcuccccccgcuacacccccaagaucggcuccgucgacauccacgucaccgacgucgacgaccucaacgaccacgagcccgucaagcucacccccgucggccucuccggcuccuccggcuccauccaccaguggcagcuccccaacuacuccggcgucgccacccacaacaugcaccucgcccccuccgucgccccccucuuccccggcgagcagauccucuucuuccgcuccaccguccccggcugcggcggcuaccccaacaccaacaucgacugccucaucccccaggaguggguccagcacuucuaccaggagggcgcccccgcccgcaccgacgucgcccuccuccgcuucaucaaccccgacaccggccgcguccucuucgagugcaagcuccacaagcacggcuucaucaccgucgccuacuccggcaaccacgaccucgucaugccccccaacggcuacuuccgcuucgaguccugggucaaccaguuccacacccucgcccccaugggcaccggccgcgccgaggagauccaguga

SEQ ID NO: 14858 - RNA, 1608 nt, Artificial Sequence
  derived and/or modified sequence opt2 from capsid_protein__Norovirus__ABZ89549
augaagauggccuccaacgacgccucccccuccuccgacggcuccgccaaccucguccccgagaucaacaacgaggucauggcccucgagcccgucgccggcgccgccaucgccgcccccgucgccggccagcagaacaucaucgaccccuggauccgcaacaacuucguccaggcccccggcggcgaguucaccgucuccccccgcaacgcccccggcgagguccuccucaaccucccccucucccccgacaucaaccccuaccucgcccaccucucccgcauguacaacggcuacgccggcggcgucgaggucgaggucguccucgccggcaacgccuucaccgccggcaagaucaucuucgccgccgucccccccaacuucccccccgagaaccucucccccucccagaucaccaugcucccccacaucaucgucgacguccgccagcucgagcccguccgcaucccccuccccgacguccgcaacaacuucuaccacuacucccgcgagaacgacuccacccuccgccucaucgccaugcucuacaccccccuccgcgccaacaacgccggcgacgacgucuucaccgucuccugccgcguccucacccgccccucccccgacuucgacuucaucuuccucgucccccccaccgucgaguccaaguccaagcccuucaccauccccauccucaccaucgaggagaugaccaacucccgcuuccccgccccccucgagaugaugaccaccggccccucccacgacaucgucguccagccccagaacggccgcugcaccaucgacggcguccuccucggcaccacccagcucucccccgucaacaucugcuccaugcgcggcguccccaccaagcgcaccaacggcaccgacaacugcuucguccagcucgagaaccccaacggcuccgccuacgaccccaccgaggacauccccgccguccucggcucccccgacuucgucggcgaguucuacggcaccaucacccagcgcucccccaacaacuccacccgcgcccaccccuucacccucaacaccggcuccccccgcuacacccccaagaucggcuccgucgacauccacgucaccgacgucgaggaccucaacgaccacgagcccgucaagcucacccccgucggccucuccggcuccuccggcuccauccaccaguggcagcuccccaacuacuccggcgucgccacccacaacaugcaccucgcccccuccgucgccccccucuuccccggcgagcagauccucuucuuccgcuccaccguccccggcugcggcggcuaccccaacaccaacaucgacugccucaucccccaggaguggguccagcacuucuaccaggagggcgcccccgcccgcaccgacgucgcccuccuccgcuucgucaaccccgacaccggccgcguccucuucgagugcaagcuccacaagcacggcuucaucaccgucgccuacuccggcaaccacgaccucgucaugccccccaacggcuacuuccgcuucgaguccugggucaaccaguuccacacccucgcccccaugggcaccggcuccggccgccgccgcauccaguga

SEQ ID NO: 14859 - RNA, 1644 nt, Artificial Sequence
  derived and/or modified sequence opt2 from capsid_protein__Norovirus__ACC69023
augaagauggccuccaacgacgccccccccuccaccgacggcuccgccggccucguccccgaggucaacaacgagaccauggcccucgagcccgucgucggcgccccccucgccgcccccgucgccggccagcacaacaucaucgaccccuggaucaagaugaacuucguccaggcccccaacggcgaguucaccgucuccccccgcaacgcccccggcgagauccuccucgaccucgagcucggccccgaccucaaccccuaccucucccaccucgcccgcauguacaacggcuacgccggcggcauggaggcccaggucguccucgccggcaacgccuucaccgccggcaagaucaucuucgccgccgucccccccaacuuccccgccgagaaccucuccgccgcccaggucaccaugugcccccacgucaucgucgacguccgccagcucgagcccgucaugcuccccaugcccgacauccgcaacaagcucuuccacuacaaccaggucgacgaccccaagcuccgccuccucgccuaccucuacaccccccuccgcgccaacaacgccggcgacgacgucuucaccgucuccugccgcguccucacccgccccacccccgacuucgaguucauguuccucgucccccccaccgucgaguccaagaccaagcccuucucccuccccggccucacccucgacgagcucuccaacucccgcuuccccgcccccaucguccagcucuacaccaacccccacgacaaccucgucguccagccccagaacggccgcugcaccaucgacggccuccuccagggcaccacccagcucgucuccugcaacgucugcuccuaccgcggcaccaucggcggcggccagcccgccucccacaccgaggaggagaucaugcccauggccuucaacauccagcgcgagaucaugcucgagaaccucgacggcucccccuacgaccccgucgacgacauccccgccguccucggcucccccgacuuccagggcgucgucuucggcauccucucccagcgcaacgccaacggccagacccgcgcccacgaggccaaggucgacacccgcgccgcccgcuucgcccccaagcucggcuucgucgucgccaccgucgaguccaccgacuuccacgacaaccagcccucccgcuucgcccccgucggccucggcggcaacggcaaccaggacuucaaccagugggcccuccccgccuacggcggcgcccucaccaacaacaccaaccucgccccccccgucaugcccgucuaccccggcgagcagcuccucuucuuccgcucccagcuccccuccuccggcggcgucgucggcggcuggcucgacugccuccucccccaggaguggguccagcacuucuuccaggaguccgccaccucccaguccgacgucgcccucguccgcuacaucaaccccaccaccggccgcguccucuucgaggccaagcuccacaagcagggcuuccucaccgucgccgccuccggcuccuacccccucgucguccccgccgacggcuacuuccgcuucgaguccugggucaaccaguucuacacccucgcccccaugggcaacggcuccggccgccgccgcgcccgcuga

SEQ ID NO: 14860 - RNA, 1644 nt, Artificial Sequence
  derived and/or modified sequence opt2 from capsid_protein__Norovirus__ACC69026
augaagauggccuccaacgacgccccccccuccaccgacggcuccgccggccucguccccgaggucaacaacgagaccauggcccucgagcccgucgucggcgccccccucgccgcccccgucgccggccagcacaacaucaucgaccccuggaucaagaugaacuucguccaggcccccaacggcgaguucaccgucuccccccgcaacgcccccggcgagauccuccucgaccucgagcucggccccgaccucaaccccuaccucucccaccucgcccgcauguacaacggcuacgccggcggcauggagguccaggucguccucgccggcaacgccuucaccgccggcaagaucaucuucgccgccgucccccccaacuuccccgccgagaaccucuccgccgcccaggucaccaugugcccccacgucaucgucgacguccgccagcucgagcccgucaugcuccccaugcccgacauccgcaacaagcucuuccacuacaaccaggucgacgaccccaagcuccgccuccucgccuaccucuacaccccccuccgcgccaacaacgccggcgacgacgucuucaccgucuccugccgcguccucacccgccccacccccgacuucgaguucauguuccucgucccccccaccgucgaguccaagaccaagcccuucucccuccccggccucacccucgacgagcucuccaacucccgcuuccccgcccccaucguccagcucuacaccaacccccacgacaaccucgucguccagccccagaacggccgcugcaccaucgacggccuccuccagggcaccacccagcucgucuccugcaacgucugcuccuuccgcggcaccaucggcggcggccagcccgccucccacuccgaggaggagaucaugcccauggccuucaacauccagcgcgagaucaugcucgagaaccucgacggcucccccuacgaccccgccgacgacauccccgccguccucggcucccccgacuuccagggcgucgucuucggcauccucucccagcgcaacgccuccggccagacccgcgcccacgaggccaaggucgacacccgcgccgcccgcuucgcccccaagcucggcuucgucgucgccaccgucgaguccaccgacuuccacgacaaccagcccucccgcuucacccccgucggccucggcggcaacggcaaccaggacuucaaccagugggcccuccccgccuacggcggcgcccucaccaacaacaccaaccucgccccccccgucaugcccgucuaccccggcgagcagcuccucuucuuccgcucccagcuccccuccuccggcggcgucgucggcggcuggcucgacugccuccucccccaggaguggguccagcacuucuuccaggaguccgccaccucccaguccgacgucgcccucguccgcuacaucaaccccaccaccggccgcguccucuucgaggccaagcuccacaagcagggcuuccucaccgucgccgccuccggcuccuacccccucgucguccccgccgacggcuacuuccgcuucgaguccugggucaaccaguucuacacccucgcccccaugggcaacggcuccggccgccgccgcgcccgcuga

SEQ ID NO: 14861 - RNA, 1671 nt, Artificial Sequence
  derived and/or modified sequence opt2 from capsid_protein__Norovirus__ACC69028
augaagauggccuccaacgacgucgccgcccccuccaccgacggcuccgccggccucguccccgaggucaacaacgagaccauggcccucgagcccgucgccggcgccgcccucgccgcccccgucgucggccagcacaacgucaucgaccccuggauccgcggcaacuucguccaggcccccaacggcgaguucaccgucuccccccgcaacucccccggcgagguccuccucaaccucgagcucggccccgagcucaaccccuaccucgcccaccucgcccgcauguacaacggcuacgccggcggcauggagguccaggucguccucgccggcaacgccuucgccgccggcaagaucaucuucgccgccgucccccccuccuuccccgucgacgcccucuccgcccccaccaucaccaugugcccccacgucaucgucgacguccgccagcucgagcccguccuccuccccaugcccgacguccgcaacaacuucuuccacuacaaccaguccuccgaccccaagcuccgccucgucgccaugcucuacaccccccuccgcgccaacucccccaccgacgacgucuucaccgucuccugccgcguccucacccgccccucccccgacuucgaguucaccuuccucaucccccccaccgucgaguccaaguccaagccccucaccaucccccagcucacccucuccgagcucuccaacucccgcuuccccgcccccaucgacaugcucaacaccucccccaacgacaacaucgucguccagccccagaacggccgcugcacccucgacggcgagcuccagggcaccacccagcuccagcccucccucaucugcuccuuccgcggcgucguccucaacgagaccucccgcauggccgucgacuacgaggaggaggaggagguccagcgcccccaggcccgcgccuucaaccacgaguaccaccuccagcuccagaaccucgacggcaccgacuacgaccccgccggcgaccuccccgccacccucggcgcccccgacuucgucggcaccgucuacggcgucgucucccagcgcaccacccgcgacuccgccgcccgcgcccacgaggccaagaucaucaccaacgacccccgcuacgcccccaagcucggcuccgucgaguucgucaccgaguccaccgacaucgucaucaacgaccagaccaaguucacccccgucggccucgcccacaaccgcgccgucgacuacaagcagugggagcucccccacuacgccggcgagcucaccgccaacaccaaccucgccccccccgucgcccccgucuaccccggcgagcagcuccucuucuuccgcuccaaccucccccucgccggcggcaccgccgccuccguccucgacuaccuccucccccaggaguggauccagcacuucuaccaggaguccuucaccccccaguccgacaucgcccuccuccgcuacgucaaccccgacaccggccgcguccucuucgaggccaagcuccaccgccagggcuacaucaccgucgccggcgccggcaccucccccgucgccgucccccccaacggcuacuuccgcuucgaguccugggucucccaguucuacgcccucgcccccaugggcuccggcaccggccgccgccgcaaccaguga

SEQ ID NO: 14862 - RNA, 1626 nt, Artificial Sequence
  derived and/or modified sequence opt2 from capsid_protein__Norovirus__ACC96732
augggcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucauccagccccgccucugcacccgcgcccgcuggcccgcccccgucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccgcuccggcaccggcgaggaggucaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggcccccgcaccaacgucgaccaggcccccuaccagggccgcgccuacgccuccgucaacgccaccgccucccucaaccucgucgacggccgcguccgcgccgucccccgcuccauccacuccuuccaggacgucauccccgaguacaacgacggccuccucgucccccucgccccccccaucggccccuuccuccccuccgagguccuccuccgcuuccgcaccuacaugcgccagaucgacaccgccgacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 14863 - RNA, 1626 nt, Artificial Sequence
  derived and/or modified sequence opt2 from capsid_protein__Norovirus__ACC96735
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuucccccgcggcucccucaccaccacccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccgucguccagccccgccucugcacccacgcccgcuggcccgcccccaucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccaguccggcaccggcgaggucgccaccuucacccucaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccgagaccaacgaggaccaggcccccuaccagggccgcgucuucgccuccaucuccgccgccgccucccucgaccucgucgacggccgcguccgcgccgucccccgcuccaucuacggcuuccaggacgucauccccgaguacaacgacggccuccucgucccccucgccccccccaucggccccuuccuccccggcgagguccuccuccgcuuccgcaccuacaugcgccaggucgacacccaggacgccgccgccgaggccaucgacugcgcccucccccaggaguucgucuccugguucgccuccaacgccuucaccguccaguccgaggcccuccuccuccgcuaccgcaacacccucaccggccagcuccucuucgagugcaagcucuacuccgagggcuacaucgcccucuccuacuccggccccggcccccucaccuuccccuccaacggcuucuucgaggucgucuccugggucccccgccucuaccagcucgccuccgucggcucccucgccaccggccgcacccucaagcaguga

SEQ ID NO: 14864 - RNA, 1623 nt, Artificial Sequence
  derived and/or modified sequence opt2 from capsid_protein__Norovirus__ACF41177
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcuccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgccuccuga

SEQ ID NO: 14865 - RNA, 1623 nt, Artificial Sequence
  derived and/or modified sequence opt2 from capsid_protein__Norovirus__ACF41180
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccaccaagcgcgacggcuccacccgcggccacaaggccaccgucuccaccggcuccguccacuucacccccaagcucggcuccguccaguucuccaccgacaccuccaacgacuucgagaucggccagaacacccgcuucacccccgucggcgucguccaggacggcuccaccacccaccagaacgagccccagcaguggguccuccccaacuacuccggccgcgacggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcgcccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14866 - RNA, 1623 nt, Artificial Sequence
  derived and/or modified sequence opt2 from capsid_protein__Norovirus__ACF41181
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucccccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccgucuacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14867 - RNA, 1623 nt, Artificial Sequence
  derived and/or modified sequence opt2 from capsid_protein__Norovirus__ACF41182
augaagauggccuccaacgacgccucccccuccgacggcuccaccgccaaccucguccccgaggucaacaacgaggucauggcccucgagcccgucgucggcgccgccaucgccgcccccgucaccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcaccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccgcccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14868 - RNA, 1623 nt, Artificial Sequence
  derived and/or modified sequence opt2 from capsid_protein__Norovirus__ACF41183
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacauccccggcacccgcgccuaccgcaugaaccucgccucccagaacuggaacaacuacgaccccaccgaggagauccccgccccccucggcacccccgacuucgucggcaagauccagggcaugcucacccagaccaccaagggcgacggcuccacccgcggccacaaggccaccgucuccaccggcuccgucgacuucacccccaagcucggcuccguccaguucgccaccgacaccgacaacgacuucgagaccggccagaacacccgcuucacccccgucggcgucauccaggacggcuccuccacccaccgcaacgagccccagcaguggguccuccccgacuacuccggccgcaccguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccucccaguccgacgucgcccuccuccgcuucgucaaccccgacaccggccgcguccucuucgagugcaagcuccacaaggccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14869 - RNA, 1623 nt, Artificial Sequence
  derived and/or modified sequence opt2 from capsid_protein__Norovirus__ACF41184
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucgccgucgaggagaugaccaacucccgcuuccccaucccccucgagaagcucuucaccggccccuccuccgcccucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucggcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14870 - RNA, 1623 nt, Artificial Sequence
  derived and/or modified sequence opt2 from capsid_protein__Norovirus__ACF41185
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguuccgcaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14871 - RNA, 1623 nt, Artificial Sequence
  derived and/or modified sequence opt2 from capsid_protein__Norovirus__ACF41186
augaagauggccuccaacgacgccaaccccuccggcggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccaggacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14872 - RNA, 1623 nt, Artificial Sequence
  derived and/or modified sequence opt2 from capsid_protein__Norovirus__ACF41187
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccgcggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14873 - RNA, 1623 nt, Artificial Sequence
  derived and/or modified sequence opt2 from capsid_protein__Norovirus__ACF41188
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgccuacaccggcuccgcccccuucacccccaagcucggcuccguccaguucuccaccgacaccgagaacgacuucgagacccaccagaacaccaaguucgcccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14874 - RNA, 1623 nt, Artificial Sequence; identical to SEQ ID NO: 13851
  derived and/or modified sequence opt2 from capsid_protein__Norovirus__ACF41190

SEQ ID NO: 14875 - RNA, 1623 nt, Artificial Sequence
  derived and/or modified sequence opt2 from capsid_protein__Norovirus__ACF41191
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccggcuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccccaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14876 - RNA, 1647 nt, Artificial Sequence
  derived and/or modified sequence opt2 from capsid_protein__Norovirus__ACF60293
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgagaaccucuccgccgcccagaucaccaugugcccccacgucaucgucgacguccgccagcucgagcccgucaaccuccccaugcccgacguccgcaacaacuucuuccacuacaaccagggcuccgacuccaagcuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccgcgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14877 - RNA, 1647 nt, Artificial Sequence
  derived and/or modified sequence opt2 from capsid_protein__Norovirus__ACF60294
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14878 - RNA, 1647 nt, Artificial Sequence
  derived and/or modified sequence opt2 from capsid_protein__Norovirus__ACF60295
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgaggucccccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaccgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14879 - RNA, 1647 nt, Artificial Sequence
  derived and/or modified sequence opt2 from capsid_protein__Norovirus__ACF60296
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14880 - RNA, 1647 nt, Artificial Sequence
  derived and/or modified sequence opt2 from capsid_protein__Norovirus__ACF60297
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccucuacaccucccccaccgagaacaucgucguccagugccagaacggccgcgucacccucgacggcgagcucgucggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14881 - RNA, 1626 nt, Artificial Sequence
  derived and/or modified sequence opt2 from capsid_protein__Norovirus__ACF72688
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuucuccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgcccccgacuucaacuucgucuaccucaccccccccaucgagcgcaccaucuaccgcauggucgaccucccccuccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaucggcgaggucgucaccuucaccaugaucgagcaggacggcuccgccuacguccccggcgaccgcgccgccccccucggcuaccccgacuucuccggccagcucgagaucgagguccagaccgagaccaccaagaccggcgacaagcucaaggucaccaccuucgagaugauccucggccccaccaccaacgucgaccaggcccccuaccagggccgcgccuacgccucccucaccgccauggccucccucgaccucgucgacggccgcguccgcgccgucccccgcuccaucuacuccuuccaggacgagcuccccgaguacaacgacggccuccucgucccccucgcccccccccucggccccuuccuccccggcgagguccuccuccgcuuccgcaccuacaugcgccagcucgacaccgccgacgccgccgcccagcccaucgacugcgcccucccccaggaguucaucuccugguucgccuccaacaacuucaccguccaguccgacgcccuccucguccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14882 - RNA, 1623 nt, Artificial Sequence
  derived and/or modified sequence opt2 from capsid_protein__Norovirus__ACH42093
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacaccaaguucacccccgucggcgucguccaggacggcuccaccacccaccagaacgagccccagcaguggguccuccccgacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14883 - RNA, 1623 nt, Artificial Sequence; identical to SEQ ID NO: 13717
  derived and/or modified sequence opt2 from capsid_protein__Norovirus__ACH42094

SEQ ID NO: 14884 - RNA, 1623 nt, Artificial Sequence; identical to SEQ ID NO: 13717
  derived and/or modified sequence opt2 from capsid_protein__Norovirus__ACH42096

SEQ ID NO: 14885 - RNA, 1623 nt, Artificial Sequence; identical to SEQ ID NO: 13717
  derived and/or modified sequence opt2 from capsid_protein__Norovirus__ACH42097

SEQ ID NO: 14886 - RNA, 1623 nt, Artificial Sequence; identical to SEQ ID NO: 13717
  derived and/or modified sequence opt2 from capsid_protein__Norovirus__ACH42098

SEQ ID NO: 14887 - RNA, 1623 nt, Artificial Sequence
  derived and/or modified sequence opt2 from capsid_protein__Norovirus__ACJ66263
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14888 - RNA, 1623 nt, Artificial Sequence
  derived and/or modified sequence opt2 from capsid_protein__Norovirus__ACJ66265
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguccccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccaacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14889 - RNA, 1623 nt, Artificial Sequence
  derived and/or modified sequence opt2 from capsid_protein__Norovirus__ACJ66267
augaagauggccuccaacgacgccaaccccuccgacggcuccaccgccaaccucguccccgaggucaacuccgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcuccgacggcuccacccgcggccacaaggccaccguccucaccggcuccgccgacuucgcccccaagcucggccgcguccaguucgccaccgacaccgacaacgacuucgaguccggccagaacaccaaguucacccccgucggcgucauccaggacggcuccaccacccaccgcaacgagccccagcaguggguccuccccuccuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14890 - RNA, 1623 nt, Artificial Sequence
  derived and/or modified sequence opt2 from capsid_protein__Norovirus__ACJ66269
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgccaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccaacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14891 - RNA, 1623 nt, Artificial Sequence
  derived and/or modified sequence opt2 from capsid_protein__Norovirus__ACJ66271
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucuccuccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14892 - RNA, 1623 nt, Artificial Sequence
  derived and/or modified sequence opt2 from capsid_protein__Norovirus__ACJ66273
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccuccuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14893 - RNA, 1623 nt, Artificial Sequence
  derived and/or modified sequence opt2 from capsid_protein__Norovirus__ACJ66275
augaagauggccuccuccgacgccucccccuccgacggcuccgccgccaaccucguccccgaggucaacaacgaggucauggcccucgagcccgucgucggcgccgccaucgccgcccccgucgccggccagcagaacaucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaaggucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagaccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacuggaacaacuacgaccccaccgaggagauccccgccccccucggcacccccgacuucgucggcaagauccagggcaugcucacccagaccacccgcggcgacggcuccacccgcggccacaaggccaccgucuacaccggcuccgccgacuucgcccccaagcucggccgcguccaguucgccaccgacaccgacaacgacuucgaguccaaccagaacaccaaguucacccccgucggcgucauccaggacggcaacaccacccaccgcaacgagccccagcaguggguccuccccggcuacuccggccgcgacggccacaacguccaccucgcccccgccgucgcccccaccuaccccggcgagcagcuccucuucuuccgcuccaccaugcccggcugcuccggcuaccccaacauggaccucgacugccuccucccccaggaguggguccagcacuucuaccaggaggccgcccccgcccaguccgaggucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14894 - RNA, 1623 nt, Artificial Sequence
  derived and/or modified sequence opt2 from capsid_protein__Norovirus__ACJ66279
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccaacuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14895 - RNA, 1623 nt, Artificial Sequence
  derived and/or modified sequence opt2 from capsid_protein__Norovirus__ACJ66281
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgagaagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14896 - RNA, 1623 nt, Artificial Sequence
  derived and/or modified sequence opt2 from capsid_protein__Norovirus__ACJ66283
augaagauggccuccaacgacgccaaccccuccgacggcuccgccgccaaccucguccucgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14897 - RNA, 1623 nt, Artificial Sequence
  derived and/or modified sequence opt2 from capsid_protein__Norovirus__ACJ66285
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgacccccgcauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugcuggguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgcuccgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14898 - RNA, 1623 nt, Artificial Sequence; identical to SEQ ID NO: 13702
  derived and/or modified sequence opt2 from capsid_protein__Norovirus__ACJ66286

SEQ ID NO: 14899 - RNA, 1626 nt, Artificial Sequence
  derived and/or modified sequence opt2 from capsid_protein__Norovirus__ACJ72216
augcgcauguccgacggcgccgcccccaaggccaacggcuccgaggccuccggccaggaccucguccccaccgccgucgagcaggccguccccauccagcccgucgccggcgccgcccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcucccucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccaucuacggccuccucgucgaccccucccuccccuccaacccccaguggcagaacggccgcguccacgucgacggcacccuccucggcaccacccccaucuccggcuccugggucuccugcuucgccgccgaggccgccuacgaguuccaguccggcaccggcgaggucgucaccuucuccaugaucgagcaggacggcuccgccuacguccccggcgaccgcgccgccccccucggcuaccccgacuacuccggccagcucgagaucgagguccagaccgagaccaccaaggccggcgacaagcucaaggucaccaccuucgagaugauccucggccccaccaccaacgucgaccaggcccccuaccagggcaaggccuacgccucccucuccaccaccgccucccucgaccucgucgacggccgcguccgcgccgucccccgcuccgucuacuccuuccaggacguccuccccgaguacaacgacggccuccucgucccccucgcccccccccucggccccuaccuccccggcgagguccuccuccgcuuccgcaccuacaugcgccagcucgacaccgccgacgccgccgcccagcccaucgacugcgcccucccccaggaguucaucuccugguucgccuccuccaacuucaccguccaguccgaggcccuccucguccgcuaccgcaacacccucaccggccagcuccucuucgaggccaagcucuacuccgagggcuacaucgccgucuccuacuccggcuccggcccccucaccuuccccaccgacggcuucuucgaggucgucuccugggucccccgccucuuccagcucgccuccgucggcucccucgccaccggccgcacccucaagcaguga

SEQ ID NO: 14900 - RNA, 1620 nt, Artificial Sequence
  derived and/or modified sequence opt2 from capsid_protein__Norovirus__ACL27297
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgccgacgucuucaccgucucccgccgcguccucacccgccccucccccgacuucgacuucaucuucuccgucccccccaccgucgagucccgcaccaagcccuucaccguccccauccucaccgucgaggagauguccaacucccgcuuccccaucccccucgagaagcucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccacgacuacaccaugaaccucgccucccagaacuggaacaacuacgaccccaccgaggagauccccgccccccucggcacccccgacuucgucggcaagauccagggcaugcucacccagaccacccgcgaggacggcuccacccgcgcccacaaggccaccgucuccaccggcuccguccacuucacccccaagcucggcuccguccaguacaccaccgacaccaacaacgacuuccagaccggccagaacaccaaguucacccccgucggcgucauccaggacggcaacaaccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggcccccacgaccucgucaucccccccaacggcuacuuccgcuucgacuccugggucaaccaguucuacacccucgcccccaugggcaacggcgccggccgccgccgcgcccucuga

SEQ ID NO: 14901 - RNA, 1623 nt, Artificial Sequence
  derived and/or modified sequence opt2 from capsid_protein__Norovirus__ACL27298
augaagauggccuccaacgacgccucccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcacccacgacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucaccaccgacaccaacaacgacuucgagaccggccagaacaccaaguucacccccgucggcgucguccaggacggcaacuccacccaccagaacgagccccagcaguggguccuccccaacuacuccggccgcaccggccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14902 - RNA, 1623 nt, Artificial Sequence
  derived and/or modified sequence opt2 from capsid_protein__Norovirus__ACL27299
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaugaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacugguccaacuacgaccccaccgaggagauccccgccccccucggcacccccgacuucgucggcaagauccagggcaugcucacccagaccacccgccgcgacggcuccacccgcggccacaaggccaccguccucaccggcuccgccgacuucgcccccaagcucggccgcguccaguucgccaccgacaccgacaacgacuucgaguccggcgagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccgccacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14903 - RNA, 1623 nt, Artificial Sequence
  derived and/or modified sequence opt2 from capsid_protein__Norovirus__ACL27300
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagcgccucuacaccggccccuccuccgccuucgucguccagccccagaacggccgcugcaccaccgacggcguccuccucggcaccacccagcucuccgccgucaacaucugcaccuuccgcggcgacgucacccacaucgccggcucccgcaacuacaccaugaaccucgccucccagaacugguccaacuacgaccccaccgaggagauccccgccccccucggcacccccgacuucgucggcaagauccagggcaugcucacccagaccacccgccgcgacggcuccacccgcggccacaaggccaccguccucaccggcuccgccgacuucgcccccaagcucggccgcguccaguucgccaccgacaccgacaacgacuucgaguccggcgagaacaccaaguucacccccgucggcgucauccaggacggcuccaccacccaccgcaacgagccccagcaguggguccuccccaacuacuccggccgcaccggccacaacguccaccucgcccccgccgucgcccccaccuaccccggcgagcagcuccucuucuuccgcuccaccaugcccggcugcuccggcuaccccaacauggaccucgacugccuccucccccaggaguggguccgccacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14904 - RNA, 1623 nt, Artificial Sequence
  derived and/or modified sequence opt2 from capsid_protein__Norovirus__ACL31312
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14905 - RNA, 1623 nt, Artificial Sequence
  derived and/or modified sequence opt2 from capsid_protein__Norovirus__ACL31313
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcguccucacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccgccuacuccggccgcgacaaccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14906 - RNA, 1623 nt, Artificial Sequence
  derived and/or modified sequence opt2 from capsid_protein__Norovirus__ACL31316
augaagauggccuccuccgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccagaacuacaccaugaaccucgccucccagaacuggaacaacuacgaccccaccgaggagauccccgccccccucggcacccccgacuucgucggcaagauccagggcaugcccacccagaccacccgcggcgacggcuccacccgcggccacaaggccaccgucuccaccggcuccguccacuucacccccaagcucggcuccguccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccaccuuccccggcgagcagcuccucuucuuccgcuccaccaugcccggcugcuccggcuaccccaacaugaaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14907 - RNA, 1623 nt, Artificial Sequence
  derived and/or modified sequence opt2 from capsid_protein__Norovirus__ACL31317
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccgacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14908 - RNA, 1623 nt, Artificial Sequence
  derived and/or modified sequence opt2 from capsid_protein__Norovirus__ACL31319
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccagguccuccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14909 - RNA, 1623 nt, Artificial Sequence
  derived and/or modified sequence opt2 from capsid_protein__Norovirus__ACL31320
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccgucaacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14910 - RNA, 1623 nt, Artificial Sequence
  derived and/or modified sequence opt2 from capsid_protein__Norovirus__ACL31322
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcagugggcccuccccgacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14911 - RNA, 1623 nt, Artificial Sequence
  derived and/or modified sequence opt2 from capsid_protein__Norovirus__ACL31324
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagcgccucuucaccggccccuccuccgccuucgucguccagccccagaacggccgcugcaccaccgacggcguccuccucggcaccacccagcucucccccgucaacaucugcaccuuccgcggcgacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcggcaccacccaccagaacgagccccagcaguggguccuccccgacuacuccggccgcgacggccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14912 - RNA, 1608 nt, Artificial Sequence
  derived and/or modified sequence opt2 from capsid_protein__Norovirus__ACL31325
augaagauggccuccaacgacgccgcccccuccaacgacggcgccgccggccucguccccgaggucaacaacgagaccauggcccucgagcccgucgucggcgccuccaucgccgccccccucaccggccagaacaacgucaucgaccccuggauccgccucaacuucguccaggcccccaacggcgaguucaccgucuccccccgcaacucccccggcgagguccuccucaaccucgagcucggccccgagcucaaccccuaccucgcccaccucucccgcauguacaacggcuacgccggcggcgucgagguccagguccuccucgccggcaccgccuucaccgccggcaagcucgucuucgccgccguccccccccacuucccccucgagaacaucucccccggccagaucaccauguucccccacgucaucaucgacguccgcacccucgagcccguccuccucccccuccccgacguccgcaacaacuucuuccacuacaaccagcagaacgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucaccaacucccgcuuccccguccccaucgacgagcucuacaccucccccaacgagucccucgucguccagccccagaacggccgcugcgcccucgacggcgagcuccagggcaccacccagcuccuccccaccgccaucugcuccuuccgcggccgcaucaaccagaaggucuccggcgagaaccacgucuggaacaugcaggucaccaacaucaacggcacccccuucgaccccaccgaggacguccccgccccccucggcacccccgacuucuccggcaagcucuucggcguccucucccagcgcgaccacgccaacgccugccgcucccacgacgccgucaucgccaccaacuccgccaaguucacccccaagcucggcgccauccagaucggcaccugggagcaggacgacguccacaucaaccagcccaccaaguucacccccgucggccucuucgagaacgagggcuucaaccaguggacccuccccaacuacuccggcgcccucacccucaacaugggccucgccccccccgucgcccccaccuuccccggcgagcagauccucuucuuccgcucccacaucccccucaagggcggcgucgccgaccccgucaucgacugccuccucccccaggaguggauccagcaccucuaccaggaguccgcccccucccagaccgacgucgcccucauccgcuucaccaaccccgacaccggccgcguccucuucgaggccaagcuccaccgcuccggcuacaucaccgucgccaacaccggcucccgccccaucgucguccccgccaacggcuacuuccgcuucgacuccugggucaaccaguucuacucccucgcccccaugggcaccggcaacggccgccgccgcguccaguga

SEQ ID NO: 14913 - RNA, 1629 nt, Artificial Sequence
  derived and/or modified sequence opt2 from capsid_protein__Norovirus__ACL31326
augaagauggccuccaacgacgccgcccccuccaacgacggcgccgccucccucguccccgagggcgucaacgagaccaugccccucgagcccgucgccggcgccuccaucgccgcccccgucgccggccagaccaacaucaucgaccccuggauccgcaccaacuucguccaggcccccaacggcgaguucaccgucuccccccgcaacucccccggcgagauccuccucaaccucgagcucggccccgaccucaaccccuaccucgcccaccucucccgcauguacaacggcuacgccggcggcgucgagguccagguccuccucgccggcaacgccuucaccgccggcaagauccucuucgccgccaucccccccaacuuccccgucgacaugaucucccccgcccagaucaccaugcucccccaccucaucgucgacguccgcacccucgagcccaucaugaucccccuccccgacguccgcaacgucuucuaccacuucaacaaccagccccagccccgcaugcgccucgucgccaugcucuacaccccccuccgcuccaacggcuccggcgacgacgucuucaccgucuccugccgcguccucacccgccccacccccgacuucgaguucaucuaccucgucccccccuccgucgaguccaagaccaagcccuucacccuccccauccucaccaucuccgagcucaccaacucccgcuuccccauccccaucgagcagcucuacaccgcccccaacgagaccaacgucguccagugccagaacggccgcugcacccucgacggcgagcuccagggcaccacccagcuccucuccuccgccgucugcuccuaccgcggccgcaccgucgccaacuccggcgacaacugggaccagaaccuccuccagcucaccuaccccaacggcgccuccuacgaccccaccgacgagguccccgccccccucggcacccaggacuucuccggcaugcucuacggcguccucacccaggacaacgucaacgucuccaccggcgaggccaagaacgccaagggcaucuacaucuccaccaccuccggcaaguucacccccaagaucggcuccaucggccuccacuccaucaccgagcacguccaccccaaccagcagucccgcuucacccccgucggcgucgccgucaacgagaacacccccuuccagcaguggguccucccccacuacgccggcucccucgcccucaacaccaaccucgcccccgccgucgcccccaccuuccccggcgagcagcuccucuucuuccgcucccgcguccccugcguccagggccuccagggccaggacgccuucaucgacugccuccucccccaggagugggucaaccacuucuaccaggaggccgcccccucccaggccgacgucgcccucauccgcuacgucaaccccgacaccggccgcacccucuucgaggccaagcuccaccgcuccggcuucaucaccgucucccacaccggcgccuacccccucgucgucccccccaacggccacuuccgcuucgacuccugggucaaccaguucuacucccucgcccccaugggcaccggcaacggccgccgccgcguccaguga

SEQ ID NO: 14914 - RNA, 1623 nt, Artificial Sequence
  derived and/or modified sequence opt2 from capsid_protein__Norovirus__ACL31340
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucucccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcaacgucaccaacaucgccggcucccagaccuacaccaugaaccucgccucccagaacuggaacaacuacgaccccaccgaggagauccccgccccccucggcacccccgacuucgucggcaagauccagggcguccucacccagaccaccaagggcgacggcuccacccgcggccacaaggccaccgucuccaccggcuccgcccaguucacccccaagcucggcuccguccaguucuccaccgacaccuccaccgacuucgagaccggccagaacacccgcuucacccccgucggcgucauccaggacggcuccaccacccacaagaacgagccccagcaguggguccuccccuccuacuccggccgcgacucccacaacguccaccucgcccccgccgucgcccccaccuuccccggcgagcagauccucuucuuccgcuccaccaugcccggcugcuccggcuaccccaacauggaccucgacugccuccucccccaggaguggguccagcacuucuaccaggaguccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcgccggccgccgccgcgcccucuga

SEQ ID NO: 14915 - RNA, 1623 nt, Artificial Sequence
  derived and/or modified sequence opt2 from capsid_protein__Norovirus__ACL31354
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcgacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14916 - RNA, 1623 nt, Artificial Sequence
  derived and/or modified sequence opt2 from capsid_protein__Norovirus__ACL31355
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14917 - RNA, 1623 nt, Artificial Sequence; identical to SEQ ID NO: 13692
  derived and/or modified sequence opt2 from capsid_protein__Norovirus__ACL31356

SEQ ID NO: 14918 - RNA, 1623 nt, Artificial Sequence
  derived and/or modified sequence opt2 from capsid_protein__Norovirus__ACL31358
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucauccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgaggcccaccagaacaccaaguucacccccgucggcgucauccaggacggcggcaccacccaccgcaacgagccccagcaguggguccuccccuccuacuccggccgcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14919 - RNA, 1647 nt, Artificial Sequence
  derived and/or modified sequence opt2 from capsid_protein__Norovirus__ACL31361
augaagauggccuccaacgacgccgcccccuccaacgacggcgccgccggccucguccccgagaucaacaacgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaagaucgacaccaccuccggccgcuucacccccaagcucggcucccucgagaucuccaccgaguccgacgacuucgaccagaacaagcccacccgcuucacccccgucggcaucggcgucgaccacgaggccgacuuccagcagugggcccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagucccaggucgcccucguccgcuacaucaaccccgacaccggccgcguccucuucgaggccaagcuccacaagcucggcuucaucaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14920 - RNA, 1623 nt, Artificial Sequence
  derived and/or modified sequence opt2 from capsid_protein__Norovirus__ACL31365
augaagauggccuccaacgacgccaaccccuccgacggcuccgccgccaaccucguccccgaggucuccaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccacaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggcuccaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14921 - RNA, 1623 nt, Artificial Sequence
  derived and/or modified sequence opt2 from capsid_protein__Norovirus__ACL36375
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagguccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcuccaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14922 - RNA, 1593 nt, Artificial Sequence; identical to SEQ ID NO: 14835
  derived and/or modified sequence opt2 from capsid_protein__Norovirus__ACN32270

SEQ ID NO: 14923 - RNA, 1608 nt, Artificial Sequence
  derived and/or modified sequence opt2 from capsid_protein__Norovirus__ACT52403
augaagauggccuccaacgacgccucccccuccuccgacggcuccgccaaccucguccccgagaucaacaacgaggucauggcccucgagcccgucgccggcgccgccaucgccgcccccgucgccggccagcagaacaucaucgaccccuggauccgcaacaacuucguccaggcccccggcggcgaguucaccgucuccccccgcuccgcccccggcgagguccuccucaaccucccccucucccccgacaucaaccccuaccucgcccaccucucccgcauguacaacggcuacgccggcggcgucgaggucgaggucguccucgccggcaacgccuucaccgccggcaagaucaucuucgccgccgucccccccaacuucccccccgagaaccucucccccucccagaucaccaugcucccccacaucaucgucgacguccgccagcucgagcccguccgcaucccccuccccgacguccgcaacaacuucuaccacuacucccgcgagaacgacuccacccuccgccucaucgccaugcucuacaccccccuccgcgccaacaacgccggcgacgacgucuucaccgucuccugccgcguccucacccgccccucccccgacuucgacuucaucuuccucgucccccccaccgucgaguccaaguccaagcccuucaccauccccauccucaccaucgaggagaugaccaacucccgcuuccccgccccccucgagaugaugaccaccggccccucccacgacaucgucguccagccccagaacggccgcugcaccaucgacggcguccuccucggcaccacccagcucucccccgucaacaucugcuccaugcgcggcguccccaccaagcgcaccaacggcaccgacaacugcuucguccagcucgagaaccccaacggcuccgccuacgaccccaccgaggacauccccgccguccucggcucccccgacuucgucggcgaguucuacggcaccaucacccagcgcucccccaacaacuccacccgcgcccaccccuucacccucaacaccggcuccccccgcuacacccccaagaucggcuccgucgacauccacgucaccgacgucgaggaccucaacgaccacgagcccgucaagcucacccccgucggccucuccggcuccuccggcuccauccaccaguggcagcuccccaacuacuccggcgucgccacccacaacaugcaccucgcccccuccgucgccccccucuuccccggcgagcagauccucuucuuccgcuccaccguccccggcugcggcggcuaccccaacaccaacaucgacugccucaucccccaggaguggguccagcacuucuaccaggagggcgcccccgcccgcaccgacgucgcccuccuccgcuucaucaaccccgacaccggccgcguccucuucgagugcaagcuccacaagcacggcuucaucaccgucgccuacuccggcaaccacgaccucgucaugccccccaacggcuacuuccgcuucgaguccugggucaaccaguuccacacccucgcccccaugggcaccggcuccggccgccgccgcauccaguga

SEQ ID NO: 14924 - RNA, 1647 nt, Artificial Sequence
  derived and/or modified sequence opt2 from capsid_protein__Norovirus__ACT52405
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucauggacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgacaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccaacgacuucgaccagaaccagcccacccgcuucacccccgucggcaucggcgucgaccacgaggccgacuuccagcaguggucccuccccgacuacuccggccaguucacccacaacaugaaccucguccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcaaccaguga

SEQ ID NO: 14925 - RNA, 1647 nt, Artificial Sequence
  derived and/or modified sequence opt2 from capsid_protein__Norovirus__ACT52407
augaagauggccuccaacgacgccacccccuccaacgacggcgccgccggccucguccccgagaucaacaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucucccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaaggucgacaccaccgccggccgcuucacccccaagcucggcucccucgagaucuccaccgaguccgacgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcaaccaguga

SEQ ID NO: 14926 - RNA, 1608 nt, Artificial Sequence
  derived and/or modified sequence opt2 from capsid_protein__Norovirus__ACT52409
augaagauggccuccaacgacgccgcccccuccaacgacggcgccgccggccucguccccgaggucaacaacgagaccauggcccucgagcccgucgccggcgccuccaucgccgccccccucaccggccagaacaacgucaucgaccccuggauccgcaugaacuucguccaggcccccaacggcgaguucaccgucuccccccgcaacucccccggcgagauccuccucaaccucgagcucggccccgagcucaaccccuuccucgcccaccucucccgcauguacaacggcuacgccggcggcgucgagguccagguccuccucgccggcaacgccuucaccgccggcaagcucgucuucgccgccauccccccccacuuccccaucgagaaccucucccccggccagaucaccauguucccccacgucaucaucgacguccgcacccucgagcccguccuccucccccuccccgacguccgcaacuccuucuuccacuacaaccaggagcccgagccccgcaugcgccucgucgccaugcucuacaccccccuccgcuccaacggcuccggcgacgacgucuucaccgucuccugccgcguccucacccgccccucccccgacuucgacuucaacuaccucgucccccccaccgucgaguccaagaccaagcccuucacccuccccauccucaccaucggcgagcucuccaacucccgcuuccccgcccccaucgacgagcucuacaccucccccaacgagggccucgucguccagccccagaacggccgcuccacccucgacggcgagcuccucggcaccacccagcucguccccuccaacaucugcucccuccgcggccgcaccaacgcccaccuccccgacaaccagcaccgcuggaacaugcaggucaccaaccccaacggcacccccuucgaccccaccgaggacguccccgccccccucggcacccccgacuuccucgccaacaucuacggcgucaccucccagcgcaaccccaacaacaccugccgcgcccacgacggcauccucgccaccuggucccccaaguucacccccaagcucggcuccgucguccucggcaccugggaggaccgcgacuucgacaucaaccagcccacccgcuucacccccgucggccucuacgacaccgaccacuucaaccagugggcccuccccaacuacuccggcgcccucacccucaacaugaaccucgcccccuccgucgccccccucuuccccggcgagcagcuccucuucuuccgcucccacaucccccucaagggcggcaccuccaacggcgccaucgacugccuccucccccaggaguggguccagcacuucuaccaggaguccgcccccuccuccaccgacgucgcccucauccgcuacaccaaccccgacaccggccgcguccucuucgaggccaagcuccaccgccagggcuucaucaccgucuccaacuccggcucccgccccaucgucgucccccccaacggcuacuuccgcuucgacuccugggucaaccaguucuacucccucgcccccaugggcaccggcaacggccgccgccgcguccaguga

SEQ ID NO: 14927 - RNA, 1623 nt, Artificial Sequence
  derived and/or modified sequence opt2 from capsid_protein__Norovirus__ACT78459
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgaccacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14928 - RNA, 1641 nt, Artificial Sequence
  derived and/or modified sequence opt2 from capsid_protein__Norovirus__ACU56258
augaugauggccuccaaggacgccccccaguccgccgacggcgccuccggcgccggccagcucguccccgaggucaacaccgccgacccccuccccauggagcccgucgccggccccaccaccgccgucgccaccgccggccaggucaacaugaucgaccccuggaucgucaacaacuucguccaguccccccagggcgaguucaccaucucccccaacaacacccccggcgacauccucuucgaccuccagcucggcccccaccucaaccccuuccucucccaccucucccagauguacaacggcugggucggcaacaugcgcguccgcauccuccucgccggcaacgccuucuccgccggcaagaucaucgucugcugcgucccccccggcuucaccuccuccucccucaccaucgcccaggccacccucuucccccacgucaucgccgacguccgcacccucgagcccaucgagaugccccucgaggacguccgcaacguccucuaccacaccaacgacaaccagcccaccaugcgccucgucugcaugcucuacaccccccuccgcaccggcggcggcuccggcaacuccgacuccuucgucgucgccggccgcguccucaccgcccccuccuccgacuucuccuuccucuuccucgucccccccaccaucgagcagaagacccgcgccuucaccguccccaacaucccccuccagacccucuccaacucccgcuuccccucccucauccagggcaugauccucucccccgacgccucccaggucguccaguuccagaacggccgcugccucaucgacggccagcuccucggcaccacccccgccaccuccggccagcucuuccgcguccgcggcaagaucaaccagggcgcccgcacccucaaccucaccgaggucgacggcaagcccuucauggccuucgacucccccgcccccgucggcuuccccgacuucggcaagugcgacuggcacaugcgcaucuccaagacccccaacaacaccuccuccggcgaccccaugcgcuccgucgacguccagaccgacguccagggcuucgucccccaccucggcuccauccaguucgacgaggucuucaaccaccccaccggcgacuacaucggcaccaucgaguggaucucccagcccuccaccccccccggcaccgacaucaaccucugggagauccccgacuacggcuccucccucucccaggccgccaaccucgccccccccgucuucccccccggcuucggcgaggcccucgucuacuucgucuccgccuuccccggccccaacaaccgcuccgcccccaacgacguccccugccuccucccccaggaguacgucacccacuucgucuccgagcaggcccccaccaugggcgacgccgcccuccuccacuacgucgaccccgacaccaaccgcaaccucggcgaguucaagcucuaccccggcggcuaccucaccugcguccccaacggcgucggcgccggcccccagcagcucccccucaacggcgucuuccucuucgucuccugggucucccgcuucuaccagcucaagcccgucggcaccgccuccaccgcccgcggccgccucggcguccgccgcaucuga

SEQ ID NO: 14929 - RNA, 1638 nt, Artificial Sequence
  derived and/or modified sequence opt2 from capsid_protein__Norovirus__ACX33982
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacguccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgccgcccagaacuucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccuccggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugaugaucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaucacccaguucgacaccggcgacgucaucaagcagaucaacgucaagcaggaguccgccuucgccccccaccucggcaccguccaggccgacggccucuccgacgucuccgccaacaccaacaugaucgccaagcucggcugggucucccccgucuccgacggccaccgcuccgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacuccuccggcaccggcccccagacccuccccaucaacggcgucuucgucuucgucuccugggucucccgcuucuaccagcucaagcccgucggcaccgccggccccgcccgccgccucggcauccgccgcuccuga

SEQ ID NO: 14930 - RNA, 1638 nt, Artificial Sequence
  derived and/or modified sequence opt2 from capsid_protein__Norovirus__ACX33983
augaugauggccuccaaggacgcccccaccaacauggacggcaccuccggcgccggccagcucguccccgaggccaacaccgccgagcccaucuccauggagcccgucgccggcgccgccaccgccgccgccaccgccggccaggucaacaugaucgaccccuggaucaugaacaacuacguccaggccccccagggcgaguucaccaucucccccaacaacacccccggcgacguccucuucgaccuccagcucggcccccaccucaaccccuuccucucccaccucgcccagauguacaacggcugggucggcaacaugaaggucaagguccuccucgccggcaacgccuucaccgccggcaagaucaucaucuccugcaucccccccggcuucgucgcccagaacuucuccaucgcccaggccaccauguucccccacgucaucgccgacguccgcguccucgagcccaucgaggucccccucgaggacguccgcaacguccucuuccacaacaacgacaacacccccaccaugcgccucgucugcaugcucuacaccccccuccgcgccggcggcuccuccuccggcaccgaccccuucgucaucgccggccgcguccucaccugccccucccccgacuucuccuuccucuuccucgucccccccaacgucgagcagaagaccaagcccuucuccguccccaaccucccccucaacacccucuccaacucccgcguccccucccucaucaaguccaugaugaucucccgcgaccacggccagaugguccaguuccagaacggccgcgucacccucgacggccagcuccagggcaccacccccaccuccgccucccagcucugcaagauccgcggcuccgucuuccacgccaacggcggcaacggcuacaaccucaccgagcucgacggcucccccuaccacgccuucgagucccccgcccccaucggcuuccccgaccucggcgagugcgacuggcacauggaggccucccccaccacccaguucgacaccggcgacgucaucaagcagaucaacgucaagcaggaguccgccuucgccccccaccucggcaccguccaggccgacggccucuccgacgucuccgccaacaccaacaugaucgccaagcucggcugggucucccccgucuccgacggccaccgcuccgacgucgaccccugggucaucccccgcuacggcuccacccucaccgaggccgcccagcucgccccccccaucuacccccccggcuucggcgaggccaucgucuucuucauguccgacuuccccaucgcccacggcaccaacggccucuccguccccugcaccaucccccaggaguucgucacccacuucgucaacgagcaggcccccacccgcggcgaggccgcccuccuccacuaccucgaccccgacacccaccgcaaccucggcgaguucaagcucuaccccgacggcuucaugaccugcguccccaacuccuccggcaccggcccccagacccuccccaucaacggcgucuucgucuucgucuccugggucucccgcuucuaccagcucaagcccgucggcaccgccggccccgcccgccgccucggcauccgccgcuccuga

SEQ ID NO: 14931 - RNA, 1611 nt, Artificial Sequence
  derived and/or modified sequence opt2 from capsid_protein__Norovirus__ACX81341
augaagauggccuccaacgacgccacccccuccgacgacggcgccgccggccucguccccgagaucaacaacgaggucauggcccucgagcccgucgccggcgccuccaucgccgcccccgucgucggccagcagaacaucaucgaccccuggauccgcaacaacuucguccaggcccccgccggcgaguucaccgucuccccccgcaacucccccggcgagcuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgccaucccccccuccuuccccuacgagaaccucucccccgcccagcucaccaugugcccccacgucaucgucgacguccgccagcucgagcccguccuccuccccaugcccgacauccgcaacgucuucuaccacuacaaccagaacaacucccccaagcuccgccucgucgccaugcucuacaccccccuccgcgccaacaacuccggcgacgacgucuucaccgucuccugccgcguccucacccgccccucccccgacuuccaguucaccuuccucgucccccccaccgucgaguccaagaccaagaacuucacccuccccguccuccgcgucuccgagaugaccaacucccgcuuccccgucguccucgaccagauguacaccucccgcaacgagaacaucaucguccagccccagaacggccgcugcaccaccgacggcgagcuccucggcaccaccauccuccaguccgucuccaucugcaacuucaagggcaccaugcaggccaagcucaacgaggagccccgcuaccagcuccagcucaccaaccucgacggcucccccaucgaccccaccgacgacaugcccgccccccucggcacccccgacuuccaggccaugcucuacggcgucgccucccagcgcuccuccaucgacaacgccacccgcgcccacgacgcccagaucgacaccgccggcgacaccuucgcccccaagaucggccagguccgcuucaaguccuccuccaacgacuucgaccuccacgaccccaccaaguucacccccaucggcgucaacgucgacgaccagcaccccuuccgccaguggucccuccccaacuacggcggccaccucgcccucaacaaccaccucgcccccgccgucaccccccucuuccccggcgagcagauccucuucuuccgcuccuacauccccuccgccggcggccacaccgacggcgccauggacugccuccucccccaggagugggucgagcacuucuaccaggaggccgcccccucccaguccgacaucgcccucguccgcuucaucaaccccgacaccggccgcguccucuucgaggccaagcuccacaagcagggcuuccucaccaucgccgccuccggcgaccaccccaucgucaugcccaccaacggcuacuuccgcuucgaggccugggucaaccccuucuacacccucgcccccgucggcaccggcuccggccgccgccgcauccaguga

SEQ ID NO: 14932 - RNA, 1611 nt, Artificial Sequence; identical to SEQ ID NO: 14931
  derived and/or modified sequence opt2 from capsid_protein__Norovirus__ACX81343

SEQ ID NO: 14933 - RNA, 1611 nt, Artificial Sequence
  derived and/or modified sequence opt2 from capsid_protein__Norovirus__ACX81345
augaagauggccuccaacgacgccacccccuccgacgacggcgccgccggccucguccccgagaucaacuccgaggucauggcccucgagcccgucgccggcgccucccucgccgcccccgucgucggccagcagaacaucaucgaccccuggauccgcaacaacuucguccaggcccccgccggcgaguucaccgucuccccccgcaacucccccggcgagcuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgccaucccccccuccuuccccuacgagaaccucucccccgcccagcucaccauguccccccacgucaucgucgacguccgccagcucaagcccguccuccuccccaugcccgacaucaagaacgacuucaaccacuacaaccagaagaacaacaccaagcuccgccucgucgccaugcucuacaccccccuccgcgccaacaacuccggcgacgacgucugcaccgaguccugccgcguccucacccgccccucccccgacuuccaguucaccuuccucgucccccccaccgucgaguccaagaccaagaacuucacccuccccguccuccgcgucuccgagaugaccaacucccgcuuccccgucguccucgaccagauguacaccucccgcaacgagaacaucaucguccagccccagaacggccgcugcaccaccgacggcgagcuccucggcaccaccauccuccaguccgucuccaucugcaacuucaagggcaccaugcaggccaagcucaacgaggagccccgcuaccagcuccagcucaccaaccucgacggcucccccaucgaccccaccgacgacaugcccgccccccucggcacccccgacuuccaggccaugcucuacggcgucgccucccagcgcuccuccaucgacaacgccacccgcgcccacgacgcccagaucgacaccgccggcgacaccuucgcccccaagaucggccagguccgcuucaaguccuccuccaacgacuucgaccuccacgaccccaccaaguucacccccaucggcgucaacgucgacgaccagcaccccuuccgccaguggucccuccccaacuacggcggccaccucgcccucaacaaccaccucgcccccgccgucaccccccucuuccccggcgagcagauccucuucuuccgcuccuacauccccuccgccggcggccacaccgacggcgccauggacugccuccucccccaggagugggucgagcacuucuaccaggaggccgcccccucccaguccgacaucgcccucguccgcuucaucaaccccgacaccggccgcguccucuucgaggccaagcuccacaagcagggcuuccucaccaucgccgccuccggcgaccaccccaucgucaugcccaccaacggcuacuuccgcuucgaggccugggucaaccccuucuacacccucgcccccgucggcaccggcuccggccgccgccgcauccaguga

SEQ ID NO: 14934 - RNA, 1611 nt, Artificial Sequence; identical to SEQ ID NO: 14931
  derived and/or modified sequence opt2 from capsid_protein__Norovirus__ACX81347

SEQ ID NO: 14935 - RNA, 1611 nt, Artificial Sequence; identical to SEQ ID NO: 14931
  derived and/or modified sequence opt2 from capsid_protein__Norovirus__ACX81349

SEQ ID NO: 14936 - RNA, 1611 nt, Artificial Sequence; identical to SEQ ID NO: 14931
  derived and/or modified sequence opt2 from capsid_protein__Norovirus__ACX81351

SEQ ID NO: 14937 - RNA, 1611 nt, Artificial Sequence
  derived and/or modified sequence opt2 from capsid_protein__Norovirus__ACX81353
augaagauggccuccaacgacgccacccccuccgacgacggcgccgccggccucguccccgagaucaacaacgaggucauggcccucgagcccgucgccggcgccuccaucgccgcccccgucgucggccagcagaacaucaucgaccccuggauccgcaacaacuucguccaggcccccgccggcgaguucaccgucuccccccgcaacucccccggcgagcuccuccucgaccucgagcucggccccgagcucaaccccuaccucgcccaccucgcccgcauguacaacggccacgccggcggcauggagguccagaucguccucgccggcaacgccuucaccgccggcaagauccucuucgccgccaucccccccuccuuccccuacgagaaccucucccccgcccagcucaccaugugcccccacgucaucgucgacguccgccagcucgagcccguccuccuccccaugcccgacauccgcaacgucuucuaccacuacaaccagaacaacucccccaagcuccgccucgucgccaugcucuacaccccccuccgcgccaacaacuccggcgacgacgucuucaccgucuccugccgcguccucacccgccccucccccgacuuccaguucaccuuccucgucccccccaccgucgaguccaagaccaagaacuucacccuccccguccuccgcgucuccgagaugaccaacucccgcuuccccgucguccucgaccagauguacaccucccgcaacgagaacaucaucguccagccccagaacggccgcugcaccaccgacggcgagcuccucggcaccaccauccuccaguccgucuccaucugcaacuucaagggcaccaugcaggccaagcucaacgaggagccccgcuaccagcuccagcucaccaaccucgacggcucccccaucgaccccaccgacgacaugcccgccccccucggcacccccgacuuccaggccaugcucuacggcgucgccucccagcgcuccucccgcgacaacgccacccgcgcccacgacgcccagaucgacaccgccggcgacaccuucgcccccaagaucggccagguccgcuucaaguccuccuccaacgacuucgaccuccacgaccccaccaaguucacccccaucggcgucaacgucgacgaccagcaccccuuccgccaguggucccuccccaacuacggcggccaccucgcccucaacaaccaccucgcccccgccgucaccccccucuuccccggcgagcagauccucuucuuccgcuccuacauccccuccgccggcggccacaccgacggcgccauggacugccuccucccccaggagugggucgagcacuucuaccaggaggccgcccccucccaguccgacaucgcccucguccgcuucaucaaccccgacaccggccgcguccucuucgaggccaagcuccacaagcagggcuuccucaccaucgccgccuccggcgaccaccccaucgucaugcccaccaacggcuacuuccgcuucgaggccugggucaaccccuucuacacccucgcccccgucggcaccggcuccggccgccgccgcauccaguga

SEQ ID NO: 14938 - RNA, 1611 nt, Artificial Sequence; identical to SEQ ID NO: 14931
  derived and/or modified sequence opt2 from capsid_protein__Norovirus__ACX81355

SEQ ID NO: 14939 - RNA, 1623 nt, Artificial Sequence
  derived and/or modified sequence opt2 from capsid_protein__Norovirus__ACX85806
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacuccuacgccggcggcuucgagguccaggucauccucgccggcaacgccuucaccgccggcaagaucaucuucgccgccgucccccccaacuuccccaccgagggccucucccccucccaggucaccauguucccccacaucgucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcaacgucacccacaucgccggcacccaggaguacaccaugaaccucgccucccagaacuggaacaacuacgaccccaccgaggagauccccgccccccucggcacccccgacuucgucggcaagauccagggcguccucacccagaccacccgccgcgacggcuccacccgcggccacaaggccaccgucuccaccggcuccguccacuucacccccaagcucggccgcauccaguucuccaccgacaccuccaacgacuucgagaccggccagaacacccgcuucacccccgucggcgucguccaggacggcuccaccacccaccagaacgagccccagcaguggguccuccccaacuacuccggccgcgacucccacaacguccaccucgcccccgccgucgcccccuccuuccccggcgagcagcuccucuucuuccgcuccaccaugcccggcugcuccggcuaccccaacaugaaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14940 - RNA, 1647 nt, Artificial Sequence
  derived and/or modified sequence opt2 from capsid_protein__Norovirus__ACX85807
augaagauggccuccaacgacgccgcccccuccaacgacggcgccgccggccucguccccgagaucaacuccgaggccauggcccucgagcccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgcccucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucaucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucucccuccccauccucaccaucuccgagauguccaacucccgcuuccccguccccaucgacucccuccacaccucccccaccgagaacaucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacgccaccacccgcgcccacgaggccaagaucgacaccaccuccggccgcuucacccccaagcucggcucccucgagaucuccaccgaguccgacgacuucgaccagaacaagcccacccgcuucacccccgucggcaucggcgucgaccacgaggaggacuuccagcaguggacccuccccgacuacgccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccucccagacccaggucgcccucguccgcuacaucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14941 - RNA, 1623 nt, Artificial Sequence
  derived and/or modified sequence opt2 from capsid_protein__Norovirus__ACX85809
augaagauggccuccaacgacgccgcccccuccaacgacggcgccgccggccucguccccgagaucaacaacgaggucaugccccucgagcccgucgccggcgccucccucgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuuccccuacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucaucgccaugcucuacaccccccuccgcgccaacaacuccggcgacgacgucuucaccgucuccuggcgcggccucaccaagaccucccccgacuucgaguucaccuuccucgucccccccaccgucgaguccaagaccaagcaguucacccuccccauccucaagaucuccgagaugaccaacucccgcuuccccguccccgucgagaugauguacaccgcccgcaacgagaaccaggucguccagccccagaacggccgcgucacccucgacggcgagcuccucggcaccaccccccuccucgccgucaacaucugcaaguucaagggcgaggucaucgccaagaacggcgacguccgcuccuaccgcauggacauggagaucaccaacaccgacggcacccccaucgaccccaccgaggacacccccggccccaucggcucccccgacuuccagggcauccucuucggcgucgccucccagcgcaacaagaacgagcagaaccccgccacccgcgcccacgaggccaacaucaacaccggcggcgaccaguacgcccccaagcucgcccaggucaaguucuucuccgagucccaggacuucgagguccaccagcccaccgucuucacccccgucggcgucgccggcgacaccucccaccccuuccgccaguggguccucccccgcuacggcggccaccucaccaacaacacccaccucgcccccgccgucgccccccucuuccccggcgagcagauccucuucuuccgcucccagauccccuccuccggcggccacgagcucggcuacauggacugccucgucccccaggaguggguccagcacuucuaccaggaggccgccaccgcccaguccgaggucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcauccaguga

SEQ ID NO: 14942 - RNA, 1623 nt, Artificial Sequence
  derived and/or modified sequence opt2 from capsid_protein__Norovirus__ACX85810
augaagauggccuccaacgacgccgcccccuccaacgacggcgccgccggccucguccccgagaucaacaacgaggucaugccccucgagcccgucgccggcgccucccucgccacccccgucgucggccagcagaacaucaucgaccccuggauccgcaacaacuucguccaggcccccgccggcgaguucaccgucuccccccgcaacucccccggcgagauccuccucgaccucgagcucggccccgagcucaaccccuaccucgcccaccucgcccgcauguacaacggccacgccggcggcauggagguccagaucguccucgccggcaacgccuucaccgccggcaagaucaucuucgccgccaucccccccggcuuccccuacgagaaccucucccccucccagaucaccaugugcccccacgucaucaucgacguccgccagcucgagcccguccuccuccccaugcccgacauccgcaacaacuucuuccacuacaaccagggcaacgaccccaagcuccgccucaucgccaugcucuacaccccccuccgcgccaacaacuccggcgacgacgucuucaccgucuccugccgcguccucaccaagcccucccccgacuucgaguucaccuuccucgucccccccaccgucgaguccaagaccaagcaguucacccuccccauccucaagaucuccgagaugaccaacucccgcuuccccguccccgucgagaugauguacaccgcccgcaacgagaaccaggucguccagccccagaacggccgcgucacccucgacggcgagcuccucggcaccaccccccuccucgccgucaacaucugcaaguucaagggcgaggucaucgccaagaacggcgacguccgcuccuaccgcauggacauggagaucaccaacaccgacggcacccccaucgaccccaccgaggacacccccggccccaucggcucccccgacuuccagggcauccucuucggcgucgccucccagcgcaacaagaacgagcagaaccccgccacccgcgcccacgaggccaacaucaacaccggcggcgaccaguacgcccccaagcucgcccaggucaaguucuucuccgagucccaggacuucgagguccaccagcccaccgucuucacccccgucggcgucgccggcgacaccucccaccccuuccgccaguggguccucccccgcuacggcggccaccucaccaacaacacccaccucgcccccgccgucgccccccucuuccccggcgagcagauccucuucuuccgcucccagauccccuccuccggcggccacgagcucggcuacauggacugccucgucccccaggaguggguccagcacuucuaccaggaggccgccgccgcccaguccgaggucgcccucauccgcuucaucaaccccgacaccggccgcguccucuucgaggccaagcuccacaagcagggcuucaucaccgucgcccacaccggcgacaaccccaucgucaugccccccaacggcuacuuccgcuucgaggccugggucaaccaguucuacucccucgcccccgucggcaccggcaacggccgccgccgcauccaguga

SEQ ID NO: 14943 - RNA, 1569 nt, Artificial Sequence
  derived and/or modified sequence opt2 from capsid_protein__Norovirus__ACY41155
augaagaugaccgaccgcgacaccaccgaccccgcccccgcccucggccagguccucccccccgaggucgaggccuccguccccgucgagcccaccgccggcgcccccgucgccgccgccaccgccggccaggucaaccccaucgaccccuggaucuucgccaacuucguccaggccccccagggcgaguucaccaucucccccaacaacaaccccggcgagauccucuucgagcucgagcucggccccgagcucaaccccuaccucgcccaccuccgccgcauguacaacggcuggaccggcuccaugcgcguccgcguccuccucgccggcaacgccuucuccgccggcaaggucgucgucuucugcgucccccccggcuucgacgccuccuaccucacccccucccaggccacccaguucccccacguccucaucgacguccgcgcccccgagcccgucgagaugccccucgaggacguccgcaacauccucuuccaccagggccccgacucccgcaugcgccucaugggcaugcucuacaccccccuccgcgccaacuccggcgccgaccccuucgucgucaccggccgcguccucaccugccccucccccaacuucuccuucuucuuccucgucccccccaccgucgaggagcgcgagguccccuucacccuccccaaccuccccgucaacaaccucucccacucccgcgucauggagcccaucgcccagaugauguccucccgcaaccuccccgccuccguccaguuccagaacggccgcugcacccucgccggcgaccuccucggcaccacccccuccucccccgccgaccucggcaccuucgucggccucaucgccgagcccggcucccgcgucgucgagcucuuccagcccaaccaggaggacuuccacgccggcuccgcccccgccccccucggcuuccccgacuucuccgacugcucccucaccuucgucgucgccuccuccaccaccgucggcgagcgcaccgucaacucccgcuccccccagaacuucacccccgcccucggccacgucacccucgacgaggaggcccccgccgaccucuuccgcgcccgccuccgcaaccucugggaccccaccgagcacuccuucuggcgcauccccgacuaccgcgccgacguccucggcuccgaguucgcccccuccgucuccgcccccggcgucggcgagacccuccucuucuucaugugcaacgucccccgccucaacggcgccaaccccaaccccugccccugccuccucccccaggaguggaucacccacuucgucuccgagcgcgccgcccuccagggcgacgucgcccuccucaacuacgucaaccccaacaccggccgcguccucuucgagugcaagcucuacgccaacggcuuccucaccgucaaccucggcgccuccgaccaggccacccuccccgucgacggcaucuucaaguucgucuccugggucuccuucuacuaccagcuccgccccgucggcaacgccuccgucggccgccgccucccccgccucaacggcuucuga

SEQ ID NO: 14944 - RNA, 1623 nt, Artificial Sequence; identical to SEQ ID NO: 14278
  derived and/or modified sequence opt2 from capsid_protein__Norovirus__ADA77528

SEQ ID NO: 14945 - RNA, 1620 nt, Artificial Sequence
  derived and/or modified sequence opt2 from capsid_protein__Norovirus__ADB22512
augaagauggccuccaacgacgccgcccccuccaacgacggcgccaccggccucguccccgaggucaacaccgagacccucccccucgagcccgucgccggcgccgccaucgccgcccccgucaccggccagaacaacaucaucgaccccuggauccgcuccaacuucguccaggcccccaacggcgaguucaccgucuccccccgcaacucccccggcgagauccucaugaaccucgagcucggccccgaccucaaccccuaccucgcccaccucucccgcauguacaacggcuacgccggcggcgucgagguccagguccuccucgccggcaacgccuucaccgccggcaagauccucuucgccgccgucccccccaacuuccccgucgacaugcucucccccgcccagaucaccaugcucccccaccucaucgucgacguccgcacccucgagcccaucaugaucccccuccccgacguccgcaacgucuucuaccacuucaacaaccagcccgccccccgcaugcgccucgucgccaugcucuacaccccccuccgcuccaacggcuccggcgacgacgucuucaccgucuccugccgcguccucacccgccccacccccgacuucgaguucaccuaccucgucccccccuccgucgaguccaagaccaagcccuucacccuccccauccucaccaucggcgagcucaccaacucccgcuuccccgcccccaucgaccagcucuacaccucccccaacgccgacgucgucguccagccccagaacggccgcugcacccucgacggcgagcuccagggcaccacccagcuccucaccaccgccaucugcuccuaccgcggcaugaccuccaaccccaccuccgacuacugggacggccaccuccuccaccucguccaccccaacggcgccaccuacgaccccaccgaggacguccccgcccccuucggcacccaggacuuccgcggcauccucuacggcaugcucacccagaacccccgcaccuccggcgacgaggccgccaacucccacggcgucuacaucuccuccaccuccgagaaguucacccccaagcucggcaccaucggccuccaccagguccagggcgaccacucccagcagcagcaguccaaguucacccccgucggcaucgccgucaacggcaacacccccuuccgccagugggagcuccccaacuacuccggcgcccucacccucaacaccaaccucgcccccgccgucggccccaacuuccccggcgagcagauccucuucuuccgcuccaacguccccuccguccagggcggccagcccaucgagaucgacugccucaucccccaggagugggucucccacuucuaccaggaguccgcccccucccaguccgacgucgcccucguccgcuacgucaaccccgacaccggccgcaccaucuucgaggccaagcuccaccgccagggcuucaucaccaucgccgccaccggcuccaaccccgucgucgucccccccaacggcuacuuccgcuucgacuccugggucaaccaguucuacgcccucgcccccaugggcaccggcaacggccgccgccgcauccaguga

SEQ ID NO: 14946 - RNA, 1623 nt, Artificial Sequence
  derived and/or modified sequence opt2 from capsid_protein__Norovirus__ADC91993
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccuccgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucacccccgucggcgucauccaggacggcggcaccacccaccgcaacgagccccagcaguggguccuccccuccuacuccggccgcaacguccagaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14947 - RNA, 1623 nt, Artificial Sequence
  derived and/or modified sequence opt2 from capsid_protein__Norovirus__ADC91994
augaagauggccuccaacgacgccacccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucucccccaagcucggccgcguccaguucgccaccgacaccgacaacgacuucgacgccaaccagaacaccaaguucacccccgucggcgucauccaggacggcgacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14948 - RNA, 1611 nt, Artificial Sequence; identical to SEQ ID NO: 14931
  derived and/or modified sequence opt2 from capsid_protein__Norovirus__ADE28701

SEQ ID NO: 14949 - RNA, 1644 nt, Artificial Sequence
  derived and/or modified sequence opt2 from capsid_protein__Norovirus__ADE28721
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuaccccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugucccucgcccccgccgucgcccccgccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 14950 - RNA, 1644 nt, Artificial Sequence
  derived and/or modified sequence opt2 from capsid_protein__Norovirus__ADE28722
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacauguucuacaccgaccccaacgagggcaucgucguccacccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 14951 - RNA, 1644 nt, Artificial Sequence
  derived and/or modified sequence opt2 from capsid_protein__Norovirus__ADE28723
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaucucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaucguccccuccgccggcggcuacggcuccggcuacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucacccccaugggcaccggccagggccgccgccgcaaccaguga

SEQ ID NO: 14952 - RNA, 1644 nt, Artificial Sequence
  derived and/or modified sequence opt2 from capsid_protein__Norovirus__ADE28724
augaagauggccuccaacgacgccgcccccuccaacgacggcgccgccaaccucguccccgaggccaacaacgaggucauggcccucgagcccgucgucggcgccuccaucgccgcccccgucgucggccagcagaacaucaucgaccccuggauccgcgagaacuucguccaggccccccagggcgaguucaccgucuccccccgcaacucccccggcgagaugcuccucaaccucgagcucggccccgagcucaaccccuaccucucccaccucucccgcauguacaacggcuacgccggcggcaugcagguccaggucguccucgccggcaacgccuucaccgccggcaagaucaucuucgccgccguccccccccacuuccccgucgagaacaucuccgccgcccagaucaccaugugcccccacgucaucgucgacguccgccagcucgagcccguccuccucccccuccccgacauccgcaaccgcuucuuccacuacaaccaggagaacaccccccgcaugcgccucgucgccaugcucuacaccccccuccgcgccaacuccggcgaggacgucuucaccgucuccugccgcguccucacccgccccgcccccgacuucgaguucaccuuccucgucccccccaccgucgaguccaagaccaagcccuucacccuccccauccucacccucggcgagcucuccaacucccgcuuccccgcccccaucgacaugcucuacaccgaccccaacgagggcaucgucguccagccccagaacggccgcugcacccucgacggcacccuccagggcaccacccagcucguccccacccagaucugcgccuuccgcggcacccucaucggccagaccucccgcuccuccgacuccaccgacuccgccccccgccgccgcgaccacccccuccacguccagcucaagaaccucgacggcacccaguacgaccccaccgacgagguccccgccguccucggcgccaucgacuucaagggcaccgucuucggcgucgccucccagcgcgacgucuccggccagcaggucggcgccacccgcgcccacgagguccacaucaacaccaccgacccccgcuacacccccaagcucggcuccauccucaugcacuccgaguccgacgacuucgucaccggccagcccguccgcuucacccccaucggcaugggcgacaacgacuggcaccagugggagcuccccgacuacuccggccaccucacccucaacaugaaccucgcccccgccgucgcccccgccuuccccggcgagcgcauccucuucuuccgcuccaucguccccuccgccggcggcuacggcuccgacuacaucgacugccucaucccccaggaguggguccagcacuucuaccaggaggccgcccccucccaguccgccgucgcccucauccgcuacgucaaccccgacaccggccgcaacaucuucgaggccaagcuccaccgcgagggcuucaucaccgucgccaacuccggcaacaaccccaucgucgucccccccaacggcuacuuccgcuucgaggccugggucaaccaguucuacacccucgcccccaugggcaccggccagggccgccgccgcaaccaguga

SEQ ID NO: 14953 - RNA, 1647 nt, Artificial Sequence
  derived and/or modified sequence opt2 from capsid_protein__Norovirus__ADK23787
augaagauggccuccaacgacgccacccccuccaacgacggcgccgccggccucguccccgagaucuccaacgaggccauggcccucgaccccgucgccggcgccgccaucgccgccccccucaccggccagcagaacaucaucgaccccuggaucaugaacaacuucguccaggcccccggcggcgaguucaccgucuccccccgcaacucccccggcgagguccuccucaaccucgagcucggccccgagaucaaccccuaccucgcccaccucgcccgcauguacaacggcuacgccggcggcuucgagguccaggucguccucgccggcaacgccuucaccgccggcaagaucaucuucgccgccaucccccccaacuuccccaucgacaaccucuccgccgcccagaucaccaugugcccccacgucaucgucgacguccgccagcucgagcccgucaaccuccccaugcccgacguccgcaacaacuucuuccacuacaaccagggcuccgacucccgccuccgccucgucgccaugcucuacaccccccuccgcgccaacaacuccggcgacgacgucuucaccgucuccugccgcguccucacccgccccucccccgacuucuccuucaacuuccucgucccccccaccgucgaguccaagaccaagcccuucacccuccccauccucaccaucuccgagauguccaacucccgcuuccccguccccaucgacucccuccacaccucccccaccgagaacgucgucguccagugccagaacggccgcgucacccucgacggcgagcucaugggcaccacccagcuccuccccucccagaucugcgccuuccgcggcguccucacccgcuccaccucccgcgccuccgaccaggccgacaccgccaccccccgccucuucaacuacuacuggcacauccagcucgacaaccucaacggcacccccuacgaccccgccgaggacauccccggcccccucggcacccccgacuuccgcggcaaggucuucggcgucgccucccagcgcaaccccgacuccaccacccgcgcccacgaggccaagaucgacaccaccgccggccgcuucacccccaagcucggcucccucgagaucuccaccgaguccggcgacuucgaccagaaccagcccacccgcuucacccccgucggcaucggcgucgaccacgaggccgacuuccagcaguggucccuccccgacuacuccggccaguucacccacaacaugaaccucgcccccgccgucgcccccaacuuccccggcgagcagcuccucuucuuccgcucccagcuccccuccuccggcggccgcuccaacggcauccucgacugccucgucccccaggaguggguccagcacuucuaccaggaguccgcccccgcccagacccaggucgcccucguccgcuacgucaaccccgacaccggccgcguccucuucgaggccaagcuccacaagcucggcuucaugaccaucgccaagaacggcgacucccccaucaccgucccccccaacggcuacuuccgcuucgaguccugggucaaccccuucuacacccucgcccccaugggcaccggcaacggccgccgccgcauccaguga

SEQ ID NO: 14954 - RNA, 1623 nt, Artificial Sequence
  derived and/or modified sequence opt2 from capsid_protein__Norovirus__ADM52743
augaagauggccuccaacgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccgcaacuacaccaugaaccucgccacccagaacuggaacuccuacgaccccaccgaggagauccccgccccccucggcacccccgacuucgucggcaagauccagggcguccucacccagaccacccgcgccgacggcuccacccgcggccacaaggccaccgucuacaccggcuccgccgacuucgcccccaagcucggccgcguccaguucgccaccgacaccgacaacgacuucgacgccaaccagaacaccaaguucacccccgucggcgucauccaggacggcaacaccgcccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaacauggaccucgacugccuccucccccaggaguggguccaguacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14955 - RNA, 1623 nt, Artificial Sequence
  derived and/or modified sequence opt2 from capsid_protein__Norovirus__ADR57234
augaagauggccuccuccgacgccaaccccuccgacggcuccaccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucaccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccagcucaacgaccccaccaucaagcucaucgccaugcucuacaccccccuccgcgccaacaacgccggcgacgacgucuucaccgucuccugccgcguccucacccgccccucccccgacuucgacuucaucuuccucgucccccccaccgucgagucccgcaccaagcccuucuccguccccauccucaccgucgaggagaugaccaacucccgcuuccccaucccccucgagaagcucuucaccggccccuccuccgccuucgucguccagccccagaacggccgcugcaccaccgacggcguccuccucggcaccacccagcucucccccgucaacaucugcaccuuccgcggcgacgucacccacaucaccggcucccacaacuacaccaugaaccucgccucccagaacuggaacuccuacgaccccaccgaggagauccccgccccccucggcacccccgacuucgucggcaagauccagggcguccucacccagaccacccgcgccgacggcuccacccgcggccaccgcgccaccgucuacaccggcuccgccgaguucgcccccaagcucggccgcguccaguucgccaccgacaccgagaacgacuucgacaccaaccagaacaccaaguucacccccgucggcgucauccaggacggcaacaccacccaccgcaacgagccccagcaguggguccuccccuccuacuccggccgcaacucccacaacguccaccucgcccccgccgucgcccccaccuuccccggcgagcagcuccucuucuuccgcuccaccaugcccggcugcuccggcuaccccaaccucgaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga

SEQ ID NO: 14956 - RNA, 1626 nt, Artificial Sequence
  derived and/or modified sequence opt2 from capsid_protein__Norovirus__AEA07712
augcgcauguccgacggcgccgcccccaaggccuccggcuccgaggccuccggccaggaccucguccccuccgccgucgagcaggccguccccauccagcccgucgucggcgccacccucgccgcccccgccgccggccagaucaaccagaucgaccccuggaucuuccagaacuucguccagugcccccucggcgaguucuccaucuccccccgcaacacccccggcgagauccucuucgaccucgcccucggccccggccucaaccccuaccucgcccaccucuccgccauguacaccggcugggucggcaacauggagguccagcucguccucgccggcaacgccuucaccgccggcaaggucgucgucgcccucgucccccccuacuuccccaagggcuccaucaccaccgcccagaucaccugcuucccccacgucaugugcgacguccgcacccucgagcccauccagcucccccuccucgacguccgccgcguccucuggcacgccacccaggaccaggaggaguccaugcgccucgucugcaugcucuacaccccccuccgcaccaacucccccggcgacgaguccuucgucgucuccggccgccuccucuccaagcccgccgccgacuucaacuucgucuaccucaccccccccaucgagcgcaccaucuaccgcauggucgaccuccccguccuccagccccgccucugcacccacgcccgcuggcccgcccccgucuacggccuccucgucgaccccucccuccccuccaacccccaguggcagaacggccgcguccacgucgacggcacccuccucggcaccacccccgucuccggcuccugggucuccugcuucgccgccgaggccgccuacgaguuccaguccggcaucggcgaggucgccaccuucacccucaucgagcaggacggcuccgccuaccuccccggcgaccgcgccgccccccucggcuaccccgacuucuccggccagcucgagaucgagguccagaccgagaccaccaaggccggcgacaagcucaaggucaccaccuucgagauggcccucggccccaccaccaacgucgaccaggcccccuaccagggccgcgucuucgccuccuucaccgccuccgccucccucgaccucgucgacggccgcguccgcgccgucccccgcuccaucuucggcuuccaggacgucguccccgaguacaacgacggccuccucgucccccucgccccccccaucggccccuuccuccccggcgagguccuccuccgcuuccgcaccuacaugcgccagaucgacuccuccgacgccgccgccgaggccaucgacugcgcccucccccaggaguucgucuccugguucgccuccaacggcuucaccguccaguccgacgcccuccuccuccgcuaccgcaacacccucaccggccagcuccucuucgagugcaagcucuacuccgacggcuacaucgcccucuccuacuccggcuccggcccccucaccuuccccaccgacggcuucuucgaggucgucuccugggucccccgccucuaccagcucgccuccgucggcucccucgccaccggccgcacccucaagcaguga

SEQ ID NO: 14957 - RNA, 1623 nt, Artificial Sequence
  derived and/or modified sequence opt2 from capsid_protein__Norovirus__AEK05311
augaagauggccuccaacgacgccaaccccuccgacggcuccgccgccaaccucguccccgaggucaacaacgaggucauggcccucgagcccgucgucggcgccgccaucgccgcccccgucgccggccagcagaacgucaucgaccccuggauccgcaacaacuucguccaggcccccggcggcgaguucgccgucuccccccgcaacgcccccggcgagauccucugguccgccccccucggccccgaccucaaccccuaccucucccaccucgcccgcauguacaacggcuacgccggcggcuucgagguccaggucauccucgccggcaacgccuucaccgccggcaagaucaucuucgccgccgucccccccaacuuccccaccgagggccucucccccucccaggucaccauguucccccacaucaucgucgacguccgccagcucgagcccguccucaucccccuccccgacguccgcaacaacuucuaccacuacaaccaguccaacgacuccaccaucaagcucaucgccaugcucuacaccccccuccgcgccaacaacgccggcgaggacgucuucaccgucuccugccgcguccucacccgccccucccccgacuucgacuucaucuuccucgucccccccaccgucgagucccgcaccaagcccuucaccguccccauccucaccgucgaggagaugaccaacucccgcuuccccaucccccucgagaagcucuucaccggccccuccggcgccuucgucguccagccccagaacggccgcugcaccaccgacggcguccuccucggcaccacccagcucucccccgucaacaucugcaccuuccgcggcgacgucacccacaucgccggcucccgcaacuacaccaugaaccucgccucccucaacuggaacaacuacgaccccaccgaggagauccccgccccccucggcacccccgacuucgucggcaagauccagggcguccucacccagaccaccaagggcgacggcuccacccgcggccacaaggccaccgucuacaccggcuccgcccccuucacccccaagcucggcuccguccaguucuccaccgacaccgagaacgacuucgagacccaccagaacaccaaguucgcccccgucggcgucauccaggacggcuccaccacccaccgcaacgagccccagcaguggguccuccccuccuacuccggcggcaacguccacaacguccaccucgcccccgccgucgcccccaccuuccccggcgagcagcuccucuucuuccgcuccaccaugcccggcugcuccggcuaccccaacauggaccucgacugccuccucccccaggaguggguccagcacuucuaccaggaggccgcccccgcccaguccgacgucgcccuccuccgcuucgucaaccccgacaccggccgcguccucuucgagugcaagcuccacaaguccggcuacgucaccgucgcccacaccggccagcacgaccucgucaucccccccaacggcuacuuccgcuucgacuccugggucaaccaguucuacacccucgcccccaugggcaacggcaccggccgccgccgcgcccucuga
